United States Patent 7,314,974 (EXPRESSION OF MICROBIAL PROTEINS IN PLANTS FOR PRODUCTION OF PLANTS WITH IMPROVED PROPERTIES) - sequence listing, part 17

SEQ ID NO: 47102 - DNA, 1575 bp, Deinococcus radiodurans
ttgcccatgaacacgcccctgacacccctgaccctggtccgccggggcctcaagctctatcccgaccacaccgccgtgattgaacccggcgggccccggttcacttaccgcgagtggggccggcgcatttatcagcttgcccgcgcgatccaggcggcaggctacggcgggcagcatgtggcggtgctttcgcccaacacgcacggcgggctgctgacctacgcgggggtgccctgggcgggcagcgtgctggtgccgctcaacactcgcctgacccccgaggaatacgagtttcagctgcggcacgccgaggtgcggctgctgctggtggacgagtcgctgcacgaccgggtgcgcgaggtggccgccgggctcggcatcgaagtctgggtgatgggcgacgcgcggggcgccggaacagccttcgaggcgaagctcgctgcgcaggacgactcgccgctgccgctgccggtgcaagacgagaacggcaccatcaccctcaacttcacctccggcacgacctccgaccccaagggcgtgatgatgacgcaccgctcgaccatgctcaacgccatcgagacgatctattacttcaaggccgaccaggacactgtttacctgcacactctgcccgatttccacgccaacggctggggcggcgtgtggagccccttcggcgtgggggcgacccatgtgaccctgcccaccgtccgcgccgacgccgcctacgacgcgattgagcagcacggcgtgacccacctctgcgccgcgcccaccgtgctgtccatgctgaccgacccggcgcacgcccgcccgctcagccgccagattcgggtggcgacggcgggcagcccgccccacgcccgcatcatcgccgacatgaacgcgctcgggtttcacgtcactcaggtgtacggcctgaccgaaaccagcccgctgattacggtggccgaactctcggcgcagcaggaggagttacccaccccgcgccgcgccgccctcatcgccaagcagggcgtggaaatgattctggcgggcgaggtggaggtgctggaccccgagctgcggcccgtgcccggcgacggcgaaacgctgggcgaaatcatggtgcgcggcaacctcgtgatgaaaggctattaccgcaacgaggaggccaccgccaaagccctggagggcggctggttccacaccggcgacgtggcggtggtgcaccccgacgggcgcatcgaaatccgcgaccgcaacaaggacgtgatcatctcgggcggcgagaacatcagcagcgtggaggtcgaaggggtgctctacgcccaccccgccgtgcgcgaagccgtggtggtcgccatgccccacgagaaatggggcgaggtgccctgcgccttcatcgccctgcaccagggccaggaagtcacccccgaagacctcacggcgcatgtgcgcgagcatctggcgggcttcaaagtccccaagcactacgaattccgcgacgatttgcccaagacggcgagcggcaagttccagaagttcatcctgcgcgccgagctgtggcaggggaaggcgcggggcgtgaactga

SEQ ID NO: 47103 - DNA, 2466 bp, Deinococcus radiodurans
atgcccgacagcactgcccttccgaccaccatccccgtctgcccggttcgcggcagcgtcatttatccgaccatggtgcagcacatcgatgccagccgcgccatttccatcaacgccatcgaagccgccatgagcggtgaaaaggtcatcctcatcgtgtcgcagcgcgacaaggacgtggacgaccccaagggcgaggacctctacgacgtgggcaccgcctgcaacgtgctgcgcgtgcgcaagaaccccgacggcaccttgcagatgctggtgagcgccgtggcccgcgtgcaggtcagcgcctatcagctcggtgactacctcaccgccgacattgagccgctggacgcgggcaagtcgggcggcgtggagctgcaagccctctcgcgcgaactcaaggacaagttcgagacggtcgccagcggtggacgcatcaacgccgagagcgtgcagaccatcaactccaaggacgacatcggggagatggccgaccacatcgccttcaacctcgatttcaagctcgaggacaagcaggcgattttggaagccgccaacgtcaccgagcgcctgaaaaagctgctgaccctcctcgacaccgagcaggaagtccaggcggtgcaggccaagattcgcgcccaggtcaaggaagaaatcgacaagaaccagcgcgagtactacctacgcgagcagatgaaggtcatccagaaggagctgcaaggcggcgacgaggaagaaggcgacgaggccgaagccttccgcgccaagatcgacgcgctcggcctgaaccccgaggtcaagaaggaaatcgaccgtgaggtgaaccgcctcgcccggatgcaccccgacgcggccgaagcctcggttatccgcacttacctgacctgggtcaccgagctgccctggaacgagcgctccgacgaccgcctcgacgtggaagaagccgcgcaggtgctcgacgaggaccactacggcctcgaaaaggtcaaggaccgcgtgctggagttcctcgccgtgcgccgcctgcgtaaagagcgcgccgagcgcggggaaatcagcgccgaagaagtcaacaaaggcccgattctggtcttcaccggccctcccggcgtgggcaagacctccatcgcccagagcatcgctaagtcgctgggccgcaagtacgtgcgtattgccctcggcggcgcccgcgacgagtcggacatccggggccaccgccgcacctacatcggcgccatgccgggccgcatcatccagggcatccgcacggcgggcaccaagaacccggtgattctgctcgacgaggtggacaagctcggcagctcgtaccaaggcgaccccagctcggcgctgctcgaagtgctcgacccctcgcagaaccagcacttcaccgaccactacctcggcgtgccgttcgacctctcggaagtcatgttcatcgccacggcgaactaccccgagcagattccggcggccctgatggaccgcatggaagtcatcgagttcaactcctacattgagcaggaaaaactcgaaatcgccaagcgttacctgctgccgcgtcagctgctgcaaaacggcctcaagcccaaccagatcagcttctccgacgccgccctcgaaaaactgatctcgcactacacccgtgaagcgggcgtgcgtaacctcgagcgcgaaatcggcacggtggcgcgcaaggtggcccgcaacatcgccaccggcaagaccaagcgggcgaaagtgaccgacaaggagctggaaaagtatctcggccagccgcgccacacgcccgaaaccgagaacatggaagacatggtgggcgtgagcaccggcatgttctacacgcccgtcggcggcgacatcctctttgtggaaacgagcatcatgaccggcaagggcggcggcctgctgctcaccgggcagctcggcgacgtgatgaaggagtcggctcgcgccgccctgacctacgccaagagcaacgccgaacgcttccacatcgaccgcgagaagctcgacaacagcgaaatccacgtccacgttccggcgggcgccattcccaaggaaggccccagcgcaggcggcgcgatggcgacctcgctcatctcggcgctgaccggcattccggcgcggcacgacgtggcgatgaccggcgaaatgacgctgaccgggcgttacctccccatcggcggcctcaaggagaaggtgctcggagcccgacgcgcgggcatcaagcacatcatcctgcccaaggccaacgagcgcgacatcaacgacatcccgctgcacctgcgctcgagcatgcgcttccacccctgcgaaacggtggatcaggtgctcgacgtggcgctcgtcggtggcctcaaggccctcgaaacgccccgcactgacagtcaggtgacgcccccggcagacagcggcagcaagggccgcaagacgggccgccgcagcccggaagcgcgggcctaa

SEQ ID NO: 47104 - DNA, 852 bp, Deinococcus radiodurans
ttgagcctccttgccccagcccaggttcctgggagtcagagcagccacgcgctatggtcggcgccgatgtctgcccccgccgctccccccctcaccggccctcttaaagtcaccaccttcaatgtcaacggcctgcgaagtgcgctgcgtaagggcctggccgactgggtggaaagcaaccaacccgacgtgctgcttctgcaagaagtccgcgctgagccgatgccggacgcgttgcccggctaccactcggcatggtttcccgcgcagaaggcgggctacagcggcgtcgccatcctctcgcgtctgccgctgaaagacgtgcgcctgggcatgccccacgacgagatggacgccgagggccgcgtcgtcagcgcggtggtggcgggcgtgcgctttgtcagcgtgtacctgccgagcggcagctccggcgaggcgcgccagggcttcaaggaccgcgtgctggccgactaccaggcgtgggtatcggagctgctcgcggcgggggagccggtcgtcatcggcggcgactacaacatcgcccaccgcgaaatcgacctcaagaactggcgcagcaaccagaaaaacagcggtttcctgccccacgagcgcacgtggatgaccgcgcacctcgccgccggactggtggactgccaccgcgactgcctcggcgaagaagccgagtacacctggtggagcaaccgcgccaatgcctacgccaacaacgtcgggtggcgcatcgattacctgctctcggcgggcgtccgggtgtccggcgtgcggtcagaccgctcggtgcggctgagcgaccacgcgccgctgaccgggtgggtggagctggaatctgaatga

SEQ ID NO: 47105 - DNA, 2094 bp, Deinococcus radiodurans
ttgattgagtggccccgagatgcagagctgtggcccaccgtcccggccccgccgccctatcctccccccatgaccgccacccgcgatgtgttgctcacctgtccccttgactgtcccgatgcctgccgcctcaaaatcaccatcgagcggcagccggacggcagcgagaaggccgtcaagctgaccggcgacccggctcacccctatacgcgcggctttgcctgtgccaagacggtccactacccggcgcggcaaaaccaccccgagcggcccctgtaccccctgcggcgcgtgaaccccaagaccgaccccgagccgcagtgggagcgcgtgacctgggacgaggcgctggacgacatcgccgggcggctgcggcaacttatcgccgagcgcgggccgcagagcatcctgccttaccactacgcgggcaacatgggcctgctggaaggctcgcacgtccacgcgctgtggcgcgcgctgggggcggcggaactcgaagaaaccatctgcgcgtcggcgggcacagcggcctgggaagtcggctacggcacccggctggcagtagatccgctggacgtaccgcacgcccgcctgatcgtgctgtggggcatcaacagtctgtccacccactcgcacctgaccccgcaaatcacggcggctcgcaaaaacggcgcgcgggtcgtctgcgtggacccttaccgcaaccgcacggcggcctttgccgacgagcacctcaaaatcaggcccggcaccgacgcggcgctggcgctgggggtcatgcgcgaactgttcgtgaacggctggactgacgccgagtacctcgcgcaggccaccgagggcgtggacgacctgcgggccgccgccgaggagtggagcccgcagcgcaccgccgaggtgacggggttgacggcagacgaggtgcgcgacttcgcccgcctcatcgggacgacccggcccacctacatccgcgtgggctacggcatgacccgctacgagaacggcgccaccgcgctgcgggcggtcacgctgctgccggcgctcaccggcgactggcgctaccggggcggcggctgcgtcatgagcacgagcggcaccttcaagctcaaccgccggcggctgggggcagcgcacgtgaccagaccggaagcgccccgcgtcaacatgaacgaactggcgaacgcactcgacccggcggtgggcttcggcgccctgttcgtctacaactgcaacccggcggtggtctcgcccgactcgggccgcgtgcgggctgggatgcggcgcgacgacctgctggtggtggtgctcgaacaggcgatgaccgagtcggcccggctggcggattatgtcctccccgcgacgactttcatggagtcgccggacctttacaccagttacggccacttctggctgggctacaaccccgccgagctgacgccccccggcgagtgccgccccaattcctgggtgtttgccgagcttgcccgccgcctgggggtggaggaaccgagcgtgtactggaccgctgacgacctgatggccgagctgctggacaccgaccatccctttctggacggcctcacccccgagcggctgaaggcggaaggcaccgttcggctcaatgttcctgacggcttcctgccctacgcgtacggagccgagacgccgagcggcaaggtgcagctcgcgcccgcgccgcgcttcgtgccggtgcaggccgaactgaacgccgactttcccctgcgtctgctcacgccgcccgcgcaccactttctcaactccacctacggcaacctgggtaacctcaaccgcgccgagggaggcgagccgcaggtattgctgtgccccgccgacgcggcggcctccggcgtgcaagacggcgagtacgcccgcctgaccagcgagcagggcgaggttcggcgccgggtcaaggtcacggacgccgcgcagcccggcgtggcggtggtggagggcacgtggtggggcctcacggcacccgatggccgcagcatcaacgaattgaccgcccagacgctgaccgacctgggcgggggaagcacctttcacaacacgcggattcgggtttcgccggcttga

SEQ ID NO: 47106 - DNA, 2733 bp, Deinococcus radiodurans
atgaaaaccgactggaagaaactgggcttcatcgtgcataagggcgacgacaaagaccccggccccgacgggacgctgacccgcgagcagggcaatcaactgtggattgtcagcggcaatccgaccccgagcaccacccgccccgacacccgcgtgcggacggtgggcgacctcaagcagcagcaggccatcatgctgagccgcgacctgattgtcgtgaagcccgcactcgcgcagccgggcgcgtggctgacgctgcacgtctcgcccactgctacgctgaagctgggggcggacggggtgagcgggggcgacaccctcgcgcttgaagaagtcgaaggtggcctgacgcccgcgctgcaagccaaagcgccgtatctggcagggtacaagctgctgcaaatccgcgcggcagaccgcgccaagctccccaccgccctgagcggtcaactcgcggtgagcagcgtgctgcccggcggcaaagtgctcgacgcgacgggcgtgcagactgcgtgggcgctcgacgacctctacgcctacgccgggccgctgggcgtgacgtggcagggcaacaagcccacggtgcggctgtgggcgccgaccgcgcaggacgtgaagctccacgtctcgcgccccgacggcacccaggaacgtaccctccccatgacccgtgacacgcagggcgtctggacagcgagcggcgaccagagctggaagggcctcgcttaccgctttgaggtgagggtcttcgcgccgagtaccggcaacatcgaaaccaacctcgtcaccgacccctattccgtcgccctgacgcggaacagcacccacagcgtgtttgccgacctcagcgacaacagccagaagcccgccgggtggaacgcactgaaaaagcccgcgctgcggagttttgccgacctgtcgttttatgagctgcacctgcgcgacttcagcgccgccgacgccagcgtgcccgccgccgagcgcggcacctacctcgcctttacccgccccggcagcgacggcatgacgcacctgcgggcgctggccggcgcggggctcaaggccgttcacctgctgcccaccttcgacatcgccaccatcaacgaggacaaggggcagtggcaaacgcccggcgacctcacccagttcgggccgaacagcgaggagcagcaaaaggccgtaaacgccgtcaaagacgccgacgcctacaactggggctacgacccctaccactccatggtccccgagggcagctacgcggtgaatcccgctgagcgcaccaaggagtaccgccagatggtgatgagcctgaacgcggcgggcctgcgcgtcgtgcaggacgtggtgttcaaccacacggcggcaagtgggcaggcggagcgcagcgtgctcgacaaaatcgtgcccggctactaccaccgcctgaacgtaaacggcggggtggagaactccacctgctgctcgaacaccgccaccgagcacaccatgatgcgccgtctgatggtggacacattggtgctgatggcgcgtgaatacaaggtggacggcttccgcttcgacctgatggggcaccacatggtcgcggacatgcaggccgcccgccgcgccctggacgcgctgacccccgccaaagacggcgtggacggcaagcagatttatctctacggcgagggctgggacttcggcgaggtgcagggcaaccggcgcggcgcgaacgcgacgcagctcaacctctacggcgcgggcatcggcaccttcaacgaccgcgtccgcgacgcgctgcgcggcggcagccccttcggcggcttgcaggaacagggcgtggcgaccgggctggcgactgttcccaacgggcaagcaggcaacgacagcgccgagaagtggggccagctggctgacctcgtgaagctggggctggcgggcaacctgcgcgactaccgcttcaccgaccacagcggcaagccggtcacgggcgggcaactcaggtacggcgacgcccccgccggttacgccgccagcccacgcgaaaccatcaactacgcctcggcgcacgacaaccagacgctctgggacgccgtgctgctcaagaccccggcgaacatgaacagcgcggcgcgggtgcgttttcagaacctcgcgcactcgtacctgctgttggggcaggggctgcccttcgtcccagcgggcgacgagctgctgcgctccaagtcgttcgacaccgattcctacaactcgggcgactggttcaatgcgctcgactggacgggccacaccaacggcttcggcaagggcctgccccccgccgagaagaacgaggcgaactgggcgctgtatcgcacgctgctcggtgacgccgcgctgaaggtgacgcccgccgacatcacccgcgccagcgaccacttccgcgaactgctgcgggtgcgctcctcgtcgagcctcttccgcctcgacacggcggcgcaggtgcagcagagcttgagcttcctgcccgcgcccaccggggtcatcgccatgaagctcagcgggggggtaagtgcgacgaacccctaccgcgacctgctggtcatcttcaacggcagcgcggacgccgtgaccctgaacgacgcctcggcgagcggcatgaagctgcaccccgtgctggcggcgagcagcgaccccatcgtgcggacgagcaaggtgagcggcacccaggcgagtgtgcccgcgctgacgacggcggtgttcgtgcgctga

SEQ ID NO: 47107 - DNA, 1521 bp, Deinococcus radiodurans
gtgaaacgctggctggcctggaccgcactgaccctcggggggctggctcaagctgccgcgccacagttaagggtggagcagggcacgctgaacggcaaggcggtgaatagcgtgcagcaattcctgggtgtgcccttcgccgcgccgccggtcggtccgctgcgctggcagccgccgcagccgccggtctggtcgggtcagcgagacgccacccagtttggtccggcctgcgcccagggcgacgggggcagcgaggactgcctgacgctgaatatttaccgcccgccgaacgcgaaaaatgccccgctgctggtgtgggtgcacggcggctttttcactgggggcgacgccagcctctttgatggctcggcgctggcccgcgagcgcggcgtggtggtggcgacggtcaactaccggctggggctctacgggtttctggcggtgccgggcgtgaccgacggcaacgcggggctgtacgacattctcggggcggtgcgttggctcaagcaaaacgccgcgagcatcggtgccgaccccggcaacatcacgctggcggggcagtcggcgggggcagcggccatctgcacgctgctggcggcgccctcggcggcgggactctttcagaaggccatcttgcaaagcgggtcgtgcgctgcgcccatttttcagaccccgctcggcgacgcccggcgcaagggcgagctgttttcccgcgctctgcgctgtgaccggggcgagacggccacctgcctgcgcggcaaaagccgggccgagctcgacggggtgcggctcaccggacgcgggccggttgacccggtgccgctgccgcccgtctatggcgacgcgctcattccgctgcggcctcaggacgctttcgcgcagggccagagcctcaaggtcgccgtcatgctcggcatcaaccgcgaggaagggcagattttcgagccttaccttcccgacctgctgcgcggcagccggacgctctaccgggcaggtctgaccctcatcaaccccttgcaggcgtgggcgctcggcgggcgctacccgctgcgcagcgacgaacagcccatccgcgccgtgacccggctgctcaccgatcaagtgtttgcctgcccgacctcgtggctggcgggcaaactcggggcggggctgccgacgtatttctatgagttcagtgacccccgcccaccgcttcagctcgctggcaaagtgaatgtcccgaacctgggcgcctatcacggcgccgaactcgcctacgtgctcgataccccggtggtcggcgtctcggatccggcgcagttctcaagcgcgcaggccaaactcgccgcgcagatgggcgaatactggacgaacttcgcccgcagcggccagcccgcctcgctggggctgacggtgtggccgacgttcaacccggcctttccccaggtgatgaccctcgaacccggcgccaccgcgctcaaacccaactttgacgggcggcaccagtgcgattactggaatggagcggaagggcgacgctga

SEQ ID NO: 47108 - DNA, 735 bp, Deinococcus radiodurans
ttgattaaggggaaatggagaggggttcggggcggcccctgcctgctctgtcggccagctttcggcagagtgggccccggctccggcgcactgacgcgggctagaccctcccgcgccgccctccaccgccgcctctaccttcgtcctatgccccgcaccgccgccgtcacccgcacgaccaaggaaaccgacatcaccgtccggctcgacctcgacgccgcaccttacgagcagcccgccaccgggcacggctttttcgaccatatgctcgacgcgctcgcccgccacagtcgcctcggtatcagtatttccggcacgggcgacctgcacatcgagccgcaccacctgatcgaggacaccggcatcacgctggggcaggcgctgtcgcaggcgctcggcgaccgcaaaggcatcgagcgctacggctcggctttcgtgccgatggacgaaacgctggcgcacgtggtcctcgacctctcgggccgcgcccacctcgccttcgagccggaaacgctggacgtgtacggcgacgcgggtggcatgacccactaccacctgcgcgagtttctgcgcggcttttgcaaccacgccggggccacgctgcacgtgcgcctgctggccgggcgcgaggcgcaccacgtcatcgaggccgtcatgaaggcgtttgcccgtgccctgcgcgacgcggtggcggtgacttcggacgcgctgccgagcaccaaggggagcctgtag

SEQ ID NO: 47109 - DNA, 1350 bp, Deinococcus radiodurans
atgacgtccgtctcgcctacccccgacggcatcctgcggcagttgcaggacgccgaggtcagctttttgcgcctgcaattcaccgacatcctggggcacaccaaaaacgtggaggtgccgcgcacgcagtttgccaaggcgctgagcggcgacgtgaccttcgacggcagcgcggtgcagggctttacgcgggtggaggagtcggacatgctgctctcgcccgacctgtccacctttctggtctacccgcagtttgcccgcgacgaccgcgagcggggccgcgtcgcccggctgatctgcgacgtgacgctgcccgacggcaccccctttgaaggcgacccccgccgggtgctgcgagcgcaggtggaacgggcgcaggcgctcgggctggagatgtacgtgggcaccgaacccgagtttttcctgtttgaacgtggccccaacggcgcggcgaccaccgtgacccatgaccgcgccggatacttcgacctcgcgccgattgaccggggcgagcgcattcgccgcgagattgccagccgcctggtggaaatgggctttgaaatcgaagcctcgcaccacgaagtcgcgccggggcagcacgagattgatttccgctacgcccccgcgctcgaaaccgccgaccgtatcgccactttcaagttcgtggtcaagcgaattgcgctcgaacacggcctgctcgccagctttctgcccaagccgattgccggggtcagcggcagtgggatgcactgtcacctcagcctcttcaaggacgggcaaaacgtctttgatgacccgggcggcgaacatggcctctcggacaccgcgcaccagttcgtcgccgggctgctcgaccacgccgagggcatgacggccatcaccaacccgctcgtcaacagctacaagcggctggtgccgggcttcgaggcccccgtcaacatcgcctggagcacgtccaaccgctcagcgctggtccgcattcccgccaagcgcggcccgtccacccgcgccgaactgcggatgcccgacccgagttgcaacccgtacctcgcgctcgccgccatgctcgccgctgggctcgacggcattgagcggcagttggagccgccgcccgccattcagcgcaacattttccgcatgacggtgcgtgaaaagcgccaccaccgcgtcaaagagctgcccggcgacctgcgcgaggcggtggacgagctggcgaaggacgaagtgattgccgccgcgctgggggaacacgtgatggagcattacgtaacggcgaagcgggcggagtggcgggagtacagttcggcggtgcacgcctgggagctggagcggtatttggatttggtgtag

SEQ ID NO: 47110 - DNA, 1929 bp, Deinococcus radiodurans
atggaccccgcactcttgacgactcccctcgtttcacccaccgacgccctgaaaaagaccgcccccgtcacgcccgagcgggcgcagcagctccgcgacatgcccgcgggcgactactggctgagcgtcgccagcgaactcacctgggacgtgccgccgaccaccgccctcgaaggcaccttcggggacttccagtatttccccggcgcgaagggcaacgtcagcgtcaactgcctcgaccgtcaccccaaaaaccgcgtcgcgctgtactacgagcgcgaagatggcctcaaggaaacgtggagctacggcgacctgaccgacgccaccgcccggttcgcggcggcattgcaagacctcggcgtggacaagggcgaccgggtggcgatttatctgtccaacgtgcccgaagcgtttatcgccattcatgcctgctaccgcatcggggcgatctactcggtcatcttcgcgggcttttcggcgtcggcggtgcgcgaccggctcaccgacgcgcagcccaaagtcgtggtttgcaccgacggcacgctgcggcgcgggcgcaacattccgctcaaggcgacgctcgacgaggcgcttgaagggttggagaagcccaccgtcatcgtcgcccgtcgcctggaccccttcctgccgctgggcgagaacgaactcgatttcgccgagctgctggagaaaacgacccgccgcgccgcgcccgtttcgctcgacgccaacgaccccggcttcatcatctacacctcgggcaccacgagcaaacccaaggggctggttcacagcggcatcggctttctgacggggacgtatgccaacgtgaagtgggcgctcaacctgcaacccgacgacgtgtactggtgcaccgccgacgtgggctggctgaccttcccgatttttgcgctggtgggcgggctggcgcacggggcgacgcacgtgatttacgagggcagcatcgacacgccgacgcccgagcggccctaccagatcatcgagaggtaccgcgccgacaaggtgtttaccgcgcccaccgccctgcggatgctgcggcgctcgggcgacgaagcgctggcacggtacgacctgagcccgctgcaactcgtcgcgctggtgggcgagccgcttgaccccgaaacctggcactggacgcacgacgtgctcggcggcggcaggctcttcgtcaacaacacctacggtcagaccgaaaccggcaccgcgtgggcgagcagcatggtgggcctcaccgaaggccgccccggctcgtgcgggcacccgctgcccggctaccgcgccgccgtggtgcacgaggacggcacgccctgcggccccaacgaactcggctcgctgacgctgaccgagcctttcccctgcctggcccgcaccgtgtggggcgaccatgaccgctacgtggagacctacctgtccgaatttcccggcaagtacgccgccgccgacgccgccctgctcgacagcgacgggcaactgtgggtcacgggccgcctggacgacgtgatgaacgtggccgggcaccgcctcggcacgatggagatggaagccgcgctgctcacccaccccgccgtcagcgaagccgccgtggtggcgatgcccgacgacatcaagggcgcggtgccggtggccttcgtggtgccgcgcgcgggcattcgcctcgacaccgacctcacctggctagaaaacgaacttgccgacgcggtggtgtccggtgtgggcgccatcgcccgtccgggccgcgtcgtcgtgacccccaccgtcccgcgcacccgcagcggcaaaatcatgcgccggctcctgcgcgacctgctgctgaccggcgaagtgaagggcgacctgacgagcctggaaaaccccgacgccctcgaaacggtgcgcgagcggctgggcggggcggcagcgggctga

SEQ ID NO: 47111 - DNA, 783 bp, Deinococcus radiodurans
atgaccggcctctgcgactcgcacctgcacacgcccctttgcggtcacgcgaccggcacgccgcgcgagtacgcgcaggccgcgctggacgccgggctgagcggtctgtgcttcaccgaccacatgccgatgccgcgctggtacgacgcgccgtggcggatgaagttggagcagttgcccgaatacatcgccgagattcaggccgtgcagcaggaatttgccgggcggctcgacgttcggctgggactggaagccgactttcaccccggcaccgagaagttcgtggaaaaggtgctgggaatgtttgattgggattacgtcatcggcagcgtccactacctcggcgcctggggcttcgacaatcccgagttcgtggccgagtacgaggagcgcgacctgggcgggctgtaccgcgactactacgcgctggtggagggcgcggcccgctcagggctgttcgacgctatcgggcacctcgacctgcctaagaagttcgggcacctcgaccccgacccggtgtacgccctgcacgcgctcgacgtggtggccgggcaggggttggcgctggacttcaacacggcgggctggcgcaagccggtcgcggaggcgtatccggcccccgacctcgtgcgggcggcggcggagcgcggcatccccttcgtcctcggcagcgacgcccaccaaccgggcgaagtcggcttccgttttgccgacgcggtgaaggagattcgggacgtggggggccgaaccgtgacgtttcgccaccgtaaaatgcagccatga

SEQ ID NO: 47112 - DNA, 1578 bp, Deinococcus radiodurans
gtgaagactgaccggcgcggcttaacggtggggcgagggctggagcagcggcagagtggaacgctcttctctaaccaccccagagcaagcccgctgactccgctcagcgggcttatgctgtctctcatgtctgctcccagctccccgcgcgtgacccgcattgcccccagccccaccggcgacccgcacgtcggcacggcgtacatcgggctgttcaaccacaccctcgcccgccagagcggaggccgcttcatcctgcgggtggaggacaccgaccgcaaccgctacgtccccgacagcgaaaaacgcattttccagatgatgcagtggctgaacctcacccccgacgaaagcccgctgcaaggcggtcccaacgggccttaccgccagtccgagcgcttcgacctctacggcgactacgcccgtcagctcgtgcagagcgggcacgcctactacgccttcgaaacgtccgatgaactcgccgccctgcgtgaggaagcgcagaaggccgggcacgtcatcgccattcccagccgtgacttgggcgcggcgcaggcgcaggcgcgggtggacgcgggcgagccggcggtcattcgcctgaaggtggaccgcgacggcgaaacggtggtcaacgacctgctgcgcgaccccatccactttgccaacaaggaaattgacgacaaggtgctgctcaaggccgacggctttcccacctaccacctcgccaacgtggtggacgaccgcttaatgcaagtcacccacgtggtccgcgccgaggagtggattacctccacgcctattcacgtactgctttaccgcgccttcggctggccggagcccgtgttcgcgcacatgccgctgctgcgcaacgccgacaaatccaagatttccaagcgcaagaatcccaccagcgtggagtggtaccagaaccagggtttcctccccgaagcgatgctcaactttctggcgacgatgggctggacgcacccggacggccaggaaatcttcgacctcgccgagttcgagcgggtctttcgtctcgaggacgtgacgctcggcggcccggtcttcgacctcgccaagctgcgctggtacaacggcaagtacctgcgcgaagtactgagcgaggacgacgtggcgcggcgactgcacgccttcctgatgcagaacaaagtcacgctgcccagcgtagacggcccgcaggacccttacttccgcgccgtcacccacctgatgattccccgcctggaagtcttcgccgacttcatggacaagacgctctacttctggtccgaggattacccggtgaacgagaaggcgcagaaagccatcgacgcgggcaaagagttgctgcctgagctggccgcccgcctcaagaacctgccgaccttcgatgccgcgagcatcaaggagatgttccacgcctacgccgaggaaaagggcctgaagatgggtaaagtgatgccccccatccgcgccgccgtcgcgggcacgatggaaagccccgacctgccggagatgcttgaagcgctgggccgcgagcgcgtgctggcgcgggtggaaaaagccgcccgctga

SEQ ID NO: 47113 - DNA, 1110 bp, Deinococcus radiodurans
atgtaccagactgttcgcccgctgctgttccggctggacgccgaggacgcccaccacctcaccctgcgcgggctggaactcgcttcgggggtgccgctgctgccccggctggcccggacgctgacggtgccgggaacacaggggccaggcgacgcggcgctgcggcgcacgctgtgggggcagaccccctcggagcagactttcgagtcgccgctgggcctcgcggcggggctggataaaaacgcgcaggcggtgccggcattcacggcattcggcttcggcttcgtggaggtcggcacggtcacgcccctcgcgcagagcggcaacgagcggccccggctgttccggctgcccgaggacgaggcactcatcaatcgcatgggcttcaacaacggcggcacggcggcgatgcacgcccggctcgcggtgctgaccgaccgggccgcgccggtgtgggtcaacatcggcaaaaacaaggtgacacccaacgaagacgccgccgaggactaccgcaaatgcgtacgggccctgggggacttggccgacgccttcgtggtcaacgtaagcagtcccaatacaccgggcttacgggcactgcaagcagcagacgacctcgccgcgctggtccgcgccgtgctggatgaggtggaagcgggccgggtccgcaccctgcgccgtccgccggtcctggtcaagctggcgcccgacctgcaccccgccgactttgaggccagcgtgggcgcggtgctggacgcgggcgcgagtggccttatcatctccaacaccaccctgtcccggggcggcctttcccaccccaaccgcgagcaggccggagggctcagtgggcgccctcttactgaccgctccaccgaactcgtgcgcgacgcctaccgcctgacgcggggccaggtgcccatcgtcggcgtcggcggcgtattcagtgccgaggacgcctacgccaagttgctcgccggggccgatttggtggaggtctactcggcgctgatctaccgggggccgggcctggtccgtgagatcaacgccggtttggtcaaactgctggagcgcgacggcgtgcggaacatagccgacgtggtgggccagggataa

SEQ ID NO: 47114 - DNA, 1707 bp, Deinococcus radiodurans
atgaagaaaaacctgctgctgatcggcgcgtccctgctgctgggcgcctgctccacgaccccggaaccgtccaagcctgaacaggaaaagcccgccacgacgaaggtcacggtcgtcggcctcaacgactttcacggcaacctcgaacccacctcgttcgccggggttatggtgcccgaccccaaggacccgaccaagcaggtcaagctgacgaccggcggcattgaagtcatcggcggctacctcgaccaggagcgcgccaagaacgccaacctgaccttcgtgggcgcgggcgacctgatcggcgcctcgcccgtgacgagcagcctgctgcgggacgagcccagcgtgatcggcctgagcaagctcggcatgcagtacagcagcctgggcaaccacgagttcgaccagggctacaaggaactgctgcggatgcaaaatggcggctgcgacagcaacgcgcccgacaaggcctgcaagttccagaacccctacccccgcgcgacctttagctggctgggcgccaacgtggaggtcaaggcgactggcaagccggccctgccggcctacgggattcaggagattggcggcgccagaatcgcctttatcggcgcggtgacgaagaccacccccaccatcgtcagccccgacggcgtggccgacctcaaattcctcgatgaagccgagtccatcaacaagtacgtgcctgagctgaaagcgaagggcgtagacgccatcatcgtgctgattcacgagggcggcgtgtccaaagacggcttcgacaagcccgcctgcggcaccctgaccggccccatcgtgaacatcgtcaacaagctcgaccccgccgtggacgcggtcatcagcgggcacacccaccagggctacaactgcgtggtcaatgggcgcactgtgattcagggcgactactacggccacctgttgcagcgcctcgacatgaccattgacctccaaaaacacaaggtcaccgacatccgcgccgccaacgtggtgatggacccgaacaccatcaccaagaacgccgagatgacggcgctggtgggccgcgccaagtcgctgaccgacgcggtcaagcagcgggccatcggctccctggcggcgccgaccatctcgcgcacgaccaacgcggcgggcgaaagcgcactgggcgacttgattgccgactcgcagctcgccgccaccgccgaccggggcgccgtcatcgccttcatgaaccccggcggcatccgcgccgacctgaacgcgacgggcggcggcaccaccgtgaccttcggggacgcctacgccgtgcagcccttcggcaacacgctggtggtcatggacctgaccggcgcccagatcaaggcgctgctcgagcagcagttcgacaacccctcggcgggccagaaccgcgtcttgcaggtcagcaagaactttacctacagctacgacagcacggcggcagcgggcaaccgggtggacccggcgagcatcaagttgggcggcgtcacactcgaccccgccaagacctaccgcgtgaccctcaactccttcctctcgacggggggcgacaacttcaccaccttcgcctcgggcaccaacgtgctgcaactgcccaacgtcagcgacctcgacgccctcacggcctacatcgtcgctcaccccggcgtggcgggcggcgcgcaggaccgcatcgtcaaactgaagtaa

SEQ ID NO: 47115 - DNA, 1245 bp, Deinococcus radiodurans
atgaacgacaagcagctcaagcagctcagccgggcgctcggcgtgggcggcagcgggcgacagcgcgtccttcccgccgccgacggcgactactacgactacctcgacaccctgaccgactcgcaggtggaggtggccgggcgcgtgcacgacttcatgcgcgccgaagtcatgccgatcatgaacgagtactggagccgcgacgaatttccccgcgacctcatcggcaagatgcgcgagctgaacctgctgcgctccatctggaacgaggacggcacccgcaagcccgacgccaccctgatcgagggcgtcgtcattctcgaagcctgccgggtggacgtgtccacggcggtctttttcggcgtgcacggcgggctcgccaccgcgtctatcgccctcggcagcgatgaggaacagaaaaagcgctggctgcccgacatgctcgacatgaaaaaaatcggcgcctttggcctgaccgaacccgagggcggctcgcaggtcagcgagggcatgcggaccacctgccgccgcgacggggacggctgggtgctcaacggcgaaaagaaatggatcggcaactccaccttctccgacttcaccgtgatctgggcgcgcgacgaggaaacgaacgaggtccggggtttcgtggtcgaggcgggcacccccggttacgacgtcgagaaaatccagggcaaaatcgcgctgcggatggtggaaaacggccacatcaccctcaaggactgccgcgtggccgacgccaaccgcttgcaggccgtgcagggctgggaaacggtgtcgcaggtgctcaagctcacccgcgccggagtggcgtggcagggcgtgggctgcgcgatgggggcgtatgaactcgcgctcgcctacacccagacccgcaagcagttcggcaaacgcatcggcgaattccagctgatccagagccacctgacgcacatgctcgccgacgtgaccgcgatgctcggcatggtcatgcgcctgtcgcacatcgccgacgaggggcgcatggacgacgcccacgccgcgctcgccaaggtgcacaccgccgcccgctgccgcgaggtcgtggcccgcgcccgcgaggtcttcggtggcaatggcatcctgcttgaacacggcgtcgccaagcacttctgcgataccgaggccatctactcctacgagggcaccaacgaaatcaacacgctggtggtgggccgcgccatcaccggcctgagcgcgttcgtctaa

SEQ ID NO: 47116 - DNA, 1368 bp, Deinococcus radiodurans
ttgccctcacctcggttcgctagcctacggaacatgaccctttccgaaactcaccccaccgcacgctccgaggcgctgtttgtccgcgcccgcgccgtgacccccggcggcgtcaacagtccggtgcgcgcctttcgcagcgtgggcggcgtgccgcgcttcatcgcctcggcgcagggggcgtacctcaccgacgccgacggcgcgcgttacctcgactacatcggctcgtgggggccgatgattctgggccacaaccacccggcggtcagagacgcggtggcgcaggcactggcgagcggcacgtccttcggggcacccaacgagcgcgaggtcgaactcgccgaactcatcgtcgaactgaccggggccgagcgggtgcgcttcgtgagcagcggcaccgaggcgaccatgagcgcgctgcggctggcacgcggctataccgggcgcaagttcatcgtcaaatttcgtgggaattaccacggacatgccgatggcctgctcgttgaggcgggcagcggcctgctgacgaacgccgaaggcgacctcggcgcggcggccccgagcagcgcgggcgtgcccgaggagtacgccgggctgacgctggtgctcgactacaacgacccggaagcgctcgacgccctgatggcgcagcgcggcgacgagattgccgccgtgattttcgagccggtggtgggcaacgccggggtgcttattcccacgtccgactttctggccgcgctgcaccgggtgcgcgacttcggcgccgtgttgattgccgacgaggtgatgaccggcttccggctctcgctcaacggggcaactgggctgctgagccttgaccctgacctgcgctgctggggcaagattgtgggcggcgggctgccggtgggtgcctacggaggccgcgccgacatcatggatttcgtgtcgccgcaggggccggtgtatcaggcgggcacgctgagcggcaacccgctggcgatggccgccggaatcgccaccctgcgcgagctgaaggcgaacccggggctttaccggcagctcgacgagtacgcggcccggctggcagcgggcctgcgcggagcggcggagcgggccggggtggcggtcagcatcaaccacatcggctcgatgctgacggtgttttttcaggacgcgcccgacggctcggtgcgcgactacgcggcggcggcccgcagcgacacggcggcgttcgcggcgtggttccaggggctgctcgcgcgcggcatctactgggcgccctcgcagtttgaaagtatcttcatcagcgcggcacacggcgagccggagttggctgccacactggaagccgccgcacaggcctttgaaggagtcaaaccgtga

SEQ ID NO: 47117 - DNA, 1857 bp, Deinococcus radiodurans
atgaaatggtggggctgggcgctgctggccctgaccggcgggctgctggtgctggtgctgtcggggtcgccccgcagccagagcgaactgaacgtcaacgactttacccaggcggtgcggacgcagcaggtcaaaaccgccgacatttcctttcagaacggcaccgcgctcgtcaccgggcgcctcacgagtggccttccctaccgcgcccgcacgctgcccgctgacccggtgttgaaactcggcacgctggaggggcgcggcgtcaccgtcacctacctgcctccgccgcgcatcagcgtgctcggcgccctgagtgtgctgctcacgctggcgctcatcggcggactgatcgcgctgctcgtccgcagccgcaatgggggcaacaacgacgcggcgagcagcttcggcaagtcgaaggcggcgattatcagcgaggggcagatcaagctcacctttgctgatgtggcgggctgcgatgaggccaagcaagacctgcaagaagtcgtggagttcctccgccagcccgagaaataccaccagctcggcgcccggattccgcgtggcgtgctgctcgtcgggcctcctgggtcggggaaaaccttgctggcgaaagcggtcgcaggcgaagccaaagtcccttacttctccatctctggctcggacttcgtggaaatgttcgtcggggtcggtgccgcacgtgtccgtgacctctttgagcaggcccgcaaagcttccccctgcattgtcttcattgacgagattgacgccgtaggccgcaagcgtggcatgaacattcaagggggcaacgacgaacgggaacagactttgaaccagttgctcgtcgagatggacggtttcgggagtgggcaggatgtgattatcctcgcggcgaccaaccggcccgatgtgctggatgccgcattgctcaggcccggacgatttgaccgtcaggtggtcgtggacgcgccggacgtgcggggccgggaacagattctgcggattcactcgcgcaagaaaccactcgacgtgtcggtggacctcggcgtgattgcccgtcggacagcggggatggtgggggccgacctcgaaaacctgctcaatgaagcggcattgctggcagcaagagaaggcaggaaccgcatcaccgggcgcgatgtagatgaagcgcgggaccgcgtgctgatggggccggagcgccgcagcatggtcgtgcgtgaagcagaccgcaaagtcaccgcctaccacgaggtcgggcacgcgctggtcgcccagttgctcccccactccgacaaggcgcacaagctgaccatcgtacctcggggccgcagcctcggctcggcgctctacacgcctgaagaccggatgcaccacacccgcacggcgctgctcgaccgcatttgcgtggcgctctccgggcacgcggcggaagaggtcatctacggcgaggtcacgaccggcgctcagaacgactttcagcaggcgaccggcctcgcgcggcgcatggtcaccgagtggggcatgagcgaggtcgggcagctcgccctggcgcaggacaacggcaattacctcggcttcgggccgcagccgacgaactacagcgaccacaccgccgagcagatcgacaccgccgtggccgacatcctcaatacccagtacgcccgcgcccacgccctgctcagcgagcatgtccacgtcctgcaccgcctgaccgacgaactggtcgcccgcgaaagcctcagcggcgacgaattgcaaacggtattgaacggcggcaccctgcccgagttgcctgccgccgtccgtcccgagggagcgccgccgcccgagggcacgctgcggccggaaggggcctga

SEQ ID NO: 47118 - DNA, 2226 bp, Deinococcus radiodurans
atgctttccgaacacctgcaagccgccctgcaacgcgccgccgacctcgcccaggcggcggggcacgagtacatcacccaggagcacctgctgctcgcgctgctgggtgaccccgaggccaaagacgccctgaatgcgctgggagccgatctaaacgccctgcgcgaagccttgactgagcaactcgccgaactcgacatcctcgacgaccccgaccccgacttcaccctgggcgtgcaccgcgtggtgcagggcgccgtgctgcaactgcacgccagcggcaagggaaaggaacaggccgacggcgcgcgcgtcctcgtcgaactgctggaggaggacgacagccccgcccgcgccgcgcttgaggcgcagggcgtgacccggctcgacctgctgaactacctgtcgcacggcgtggcgaaagcgccgggccacagccgcgaacgccgggtggccggggtagacggcgaattgacggcggagggcgcccccgccgaggaaaacccgctggaagcctacgcgcagaacctcaccgaggcggcaaaaaacggagagttcgacccggtgattggccggggcgccgaactcgaacgggtggtgcacattctggcgcggcgcggcaagaacaacccggttctggtgggcgagccgggcgtgggcaaaaccgcgctggctgaggggctggcacagcgggtggccgatggcaaggcgcccggcttcctgcggggggcgtcggtgtacgcgctcgacctgggggcactgttggccggcacgcgctaccggggcgacttcgaggggcggctcaaggccgtgctggccgcgctcgacgggcagaattcggtgctgttcatagacgagctgcacaccctggtcggcgccggggcgacagagggcggcagtgtggacgccgcgaacctgctcaagcctgcgctggcgcggggaaaattacgggtcatgggcgccaccacgcctgccgaactgcgcctgctggaaaaggaccgggcgctgtggcgacgttttcagacggtggacgtgcccgagccctccgaggccgacgcggtgcagattttgcaaggcctcgcgcctaagtacgcagcccaccacggcgtcacctacactccgccagccctggaagccgccgtgcgcctctcggcccgctacctgcgcgaccgcttcctgcccgacaaggcgattgacgtgctcgacgaggcgggggcggcccgcagtagcactggccagggcggcgaaatagacgtgcccgacatcgaaagcacggtggcacgcatggcccgcgtgccggtaggcgcggtgaaggccgaggaagtgcagagcctcgccacgctggaagccgacctcaaccgccgggtttacggacaggaacccgcggtaagcgcagtgtcctcggcggtcaagctcgcccgcgcgggcctgcgcaacccgcaaaagccgcaggggtcgttcctgtttgccgggccgactggggtgggcaaaactgaactcgcccgcgcgctggccgagcggctgggcgtcgaacttatccgcttcgacatgtccgagtaccaggagccgcacacggtggctcgcctcatcggggcgcctcccggctacgtgggcttcgatcagggcggactgctgaccgacgcggtggcgaaaaaccctcacgcagtgctgctgctcgacgaaatcgagaaggcgcaccccgacgtctacaacatcttcctgcaactgatggaccacggcaccctgaccgaccacgcgggcaaaaaggtggacgggcgcggcctgattctgattttcaccaccaatgccggggccgccgacgccagccgcccggcgctgggtttctcgcgagagggccgtgccggagagcaggccgaggccgtcaagcgcacctttacccccgagttccgcaaccgcctggacgccgtaatttacttcgcgccgctctcgcgcacggtgatgaccagcgtggtggacaagttcctgcgtgagctgggcgagcagctgaccgagcgcggcgtgaccctgaccgtgacccccgccgcccgcgcccgcttggccgaactgggctacgacccgctgctgggcgcccggcccctcgcccgcgtcatcgaggacaagctgggccgccctttagccgacgaactgctgttcgggcgtctgaaggacggcggcgcggtgaaggtgggcgtgcagggcggggaattcagctttgccgtgagctga

SEQ ID NO: 47119 - DNA, 1419 bp, Deinococcus radiodurans
ttggcgaggggccgcccgtgcctgtccgctcagcgacttggcgaggaaccccgtgtgaacagcaccgggcggtacagtgggcccatgcgtgtgctgcatctcgcctccgaggtcttccccttttcccgctccggtggcctgggcgacgtgctgggagcgctgcccgctgtgcaggcgcggctgggcgaagacgcagaagtcacggtcctctcgccgtggtacgcctccttgcagggcgagccgcaggaactctggcgcggggaagcctggggcgagcaggcgtggctgggcgaactccgtcaggacggcgtgcgctacctctttctcggcctgaacgagtttcagcgccccggcctctatcaccccgacgacgtagagcgcttctgcgccttcgggcgagcggcgctcccggcactggacgcggtgggcgtgaccccggacgtgctgcacgggcacgactggcaggcgggactggtggtcgcccacgcccggctgcgtggcctgcggaccgccttttcggtccacaacctgcaataccagggccgctggaacctgcacgaagcggcgggctggaccgggctcccggactggaccttcgggcccgatggggtggagtttttcggcgacctcaacctgatgaaagcgggcctgaactttgctgggcacgtcaccaccgtcagccccacctacgcgcaggaaatcaccacgccgcaatacggcgaggggttggaagggctgctggtgcggctgacccacgagggccgactctcgggcatcctcaacgggctcgaccaggaccgctggaacccgcgcaccgaccccgacatcgccgcctacagcgacccggcaggcaaggcaggggccgtgaaggcgctgcggcaggaattcggcctggacgacgccccgattctggcgacggtcagccgcctcgccgaccagaagggcatggacctgctgattacggcgctgcccgaactggtgcgcgactggaacgtggtggtgctcggcggcggcgacccgctgctggaagccgcgctgaccggctgggccaaccacccccgcgtcgccttcgcttcgggcatgaacgagccgttggcgcaccgcatctacgccggcgcccacgcgtttgccatgcccagccgcttcgagccgtgcggcctctcgcagctcatcgccatgcgctacggcaccctgcccatcgtgcgcgaaaccggcggactggccgacaccgtgccgcccgaagtcggtttccgctttgccgacgccaccgcgcccgccttcctgcaagcctgccgcgaggcccaggccgcctttcaggacccggcgcagtggcagacccgcgccacccgcgccatgtcattggatttctcctgggacggtccggcacggcaatacctggaactttaccgggggctgtaa

SEQ ID NO: 47120 - DNA, 1269 bp, Deinococcus radiodurans
atgaacatcgagaaagtcatcgcccgtgaagtgctggattcgcgtgggaaccccaccgtcgaagccgaagtccacctcgacagcggtttttcgggccgggccatcgtgccttcgggagcgagtaccggcagccacgaggcgctcgaactgcgtgacggcggcgagcggtacatgggcaagggcgtggaacgtgccgtgcagaacgtgcgtgaggccctcggcccggccctcatcggcatggacgccagtgagcaggccgccatcgacaaggcgctgatggacgtggacggcacctccaacaagggcaacatgggcggcaacgcgattctggcggtgagcctcgcgactgcccgcgccgccgctgccgagctcgacatcccgctctaccgctacctcggcggctccaacgccaagaccctgcctgtgcccatgatgaacgtcatcaacggcggcgcccacgccgacaacagcgtggattttcaggagttcatggtgatgccggtcggcgctccgagcttccgtgaagcactgcgctacggcgccgagacctttcaccacctgaaaaaagtcctcagcgggcgcggctacaacaccaacgtcggcgacgaaggcggttttgcgccggacctcaagagcaacgaggaagccctcgaagtgctgcttgaagccattcagcaggcgggctacgaacccggcaaggacatctgcatcgcgctcgaccccgccgtgaccgagctgtacaaggacggccagtaccacctggagagcgagggccgcgtgctgagcagcgacgagatgatcgacttctgggccgactggaccagccgctacccgattgtcagcatcgaagacggcctcgctgaagacgactgggacggctgggaacgcctgaccgccaaggtgggcgccaagacccagctggtgggcgacgacctgttcgtgaccaaccccgagcgcttgcagcagggcatcgaccgcaaggtgggcaacgcgattctggtcaaggtgaaccagatcggctccctcaccgagagcatggacgccatcgaactcgccaagcgccaccactacggcaccatcatcagccaccgctcgggcgagtccgaagacgcctttatcgccgacctcgctgtggcgaccaacgccgggcagatcaagaccggctcggccagccgctcggaccgtatcgccaagtacaaccagctgctgcgcatcgaagaccagctcggcgaccgagccgtgttcccgggccgcaaggcgctgcgctaa

SEQ ID NO: 47121 - DNA, 1464 bp, Deinococcus radiodurans
atgaccaccactgatctgagaacaacttatagctccgtcactcgcagccaggcttactttgacggcgaatggcgcaacgcgccgcgcaactttgaggttcgtcatccaggcaatggcgaagtgatcggcgaagtcgccgactgcactcctaccgatgcacgccaggccattgacgccgccgaggtagctctgcgcgagtggcggcaggtcaacccctacgaacgcggcaaaatcctgcgccgctggcacgacctgatgttcgaacacaaagaagaactcgcccagctcatgacccttgaaatgggcaaaccgatcagcgagacgcgcggtgaagtgcactacgcggcgagctttatcgagtggtgcgctgaggaagccggacgcatcgccggtgagcgcatcaacctgcgctttccgcataagcgtggcctgaccatcagcgagccagtgggcatcgtttatgccgtgacgccctggaacttccccgctggaatgatcacccgcaaagccgcgcctgcgctggctgccggctgcgtcatgatcctcaaacctgccgaactctcgcccatgactgcgctctatctcactgagctgtggctcaaggcaggaggtccggcgaacacttttcaagtcctacccactaacgacgcttctgcattgactcagccttttatgaacgacagccgggtccgcaagctgacgttcaccggcagcactgaggtggggcgcctgctttaccagcaagccgctggcacgatcaagcgcgtcagcctggaactcggcggacatgcgcccttccttgtctttgacgatgccgaccttgagcgcgcagcgagcgaagtcgtggcgagtaaattccgcaactcgggtcagacctgcgtctgcaccaaccgggtctatgtccagcgcggggtcgccgaagaatttatccggttgctcaccgagaagacggcagctttgcagctgggcgatcctttcgatgaggccacccaggtcggtccggtcgttgagcaagcaggcctcgataaagtccagcggcaagtgcaagacgccctgacgaagggcgcacaggctacaactggcgggcaagtgagcagcggcctctttttccagcccactgtcttggttgatgtggcaccagattcgctaatcttgcgagaggaaacattcgggccagttgctccggtgactatctttgacactgaagaggaaggcctgcgcttggccaacgacagcgagtatggattagctgcctacgcctatacccgcgatctgggccgtgccttccgcattgccgagggacttgaatacggcattgtcggtatcaacgatggtctgcccagttcggcagccccacacgtcccctttggtggcatgaaaaacagtggcgtaggccgtgaaggcgggcattggggcctggaggaataccttgaaaccaagttcgtctcgcttggtctttcctga

SEQ ID NO: 47122 - DNA, 1179 bp, Deinococcus radiodurans
atgaaagcaattgtctggcaaggcgtcaacaaagtcggtgtcgaaacggttccggatcccacactgctcctgcccaccgacgccatcgtcaaaatcacttcgaccgccatctgcggctcggacctgcacctgctcgacgggtacatccccagcatggaaaccggcgacattctcggccacgaattcatgggtgaagtcgtcgaagtcggcagcgaggtcaggaagctcaaggtgggcgaccgggtggtcgtgcccttcaacatcgcttgcggagtttgcgacccctgcaaacgtggctttttcagcgcctgcgacaactccaacccgaatcaccgcatggcagaggctctctacggcgccaccagcggcggggctctgttcggctactcgcatatgtacggcggctatgcgggcgggcaagcccagtacgtgcgcgtgccgtttgccgatgtggggccgttcaaaatagagtcgggcttgaaagacgagcaagtcctgttcctcaccgacatcttccccaccggctaccaggccgccgagcagtgcaacattgtgccgggccgcgacgtggtggccgtgttcggtgccgggccggtcggtcagttcgctgcccgcagcgcgcagatgctcggggctgcacacgtcatcgtgattgaccgcgtgcccgaacgcctggcgatggccgaagctgccggctgtcagacgatcaactacgagaaggaagacgtgctgctttccttgcgcgaagccactggcggacgcggacctgaccacgtgattgacgccgtcggcatggaagcccacggccacggccccggctccaccatggacaaggtgcagcagaacctcaagctgacttttgaccgtattaccgccctgcgctgggccatcctgagctgcgccaagggcggcaccgtcagcatgccgggtgtctacggcggcttggtggacaagatgcccatcggcgcggccttcgccaagggcctgattttccgtatgggccaaacccacacccaccgtcatatccccagtctgctgggccgcatcgaagccgggcagatcgaccccagtttcgtcattacccaccgcgcctcgctcgatcaggcgcccgagctgtacaagaccttccgcgacaaacaggactgctgcatcaaggttgtgctcaacccctgggcctga

SEQ ID NO: 47123 - DNA, 906 bp, Deinococcus radiodurans
atgatcaccaccttcgagcaagtcagcaagacctacgggcacgtcaccgcgctcagcgacttcaacctcaccctgcgcaccggcgaactgactgccctgctcgggcccaacggggcgggcaaatccaccgccatcggcctgctgctcggtctgagtgcgccgagtgccggacaggtccgggtgctgggcgccgatccccggcgaaacgatgtgcgggcgcggatcggggccatgccgcaggaaagtgccctgccggcgggtctgacggtgcgcgaggcggtcacgctgttcgcgtccttttacccggcgccgctgggcgtagacgaggcgctggcactggcggacttgggcccggtggccggacgccgcgccgcgcagctgtcgggcggacaaaagcgccgcctcgcctttgccctcgcggtggtgggcgaccctgagctgctgctgatcgacgagccgaccactgggatggacgcgcaaagccgcgccgcgttctgggaagcggtgaccgggttgcgggcgcggggccgcaccatcctgctcaccacccattacctcgaagaagccgagcgcaccgccgaccgggtggtggtaatgaatggaggccggattctggccgacgacacgccccagggcctgcgctcgggcgtgggcggcgcccgggtgagcttcgtctccgatctggtgcaggccgagctggagcggctgccgggggtgagcgcggtgcaggtggacgcggctgggcgggccgacctgcgaaccagcgtccccgaagctctgctcgcggccctgatcggctcgggcaccacgttcagcgacctcgaagtgaggcgggccacgctggaagaggcgtatttgcaactcaccgggccgcaggacatgacagctgtcacccgcagcgcctga

SEQ ID NO: 47124 - DNA, 1692 bp, Deinococcus radiodurans
ttgttttgtccacaatggaagtttacatttttgatcaaccaaaggccctgcgccgctgggcagttgtccaggcgaggctttgccccctctttcgccgctttctctggagccgccatgtccgatatcgaagccctgaaaaaagaattgcccccgttccagattttcgacctgattccccagtacgccgccgccgggcaaatcgaccccgagaaaatcgacctgctgaagtgggccggcgtctacccccagcgcccgcaggaagacggcttcctgatgatgcgcgtgaaggtgcccaccgccgagctgcacactgacgctctgcgggtcgtggccggcatctccgaggacttcgggcgcgggctgctcgacgtgaccgaccgtcaggccttccagttccactggctgcggattcaggacattcccgagattctggaccggctggaaacggtgggcctgcacaccaagggggcctgcggcgacaccgtgcgcgccgtgatcgcctcgccgctggccggcctcgacgcccgcgagaagatcgacgtgcgcccgctcgccgccgcgatggaaggcaccctcagcggcaaccacgacttcgaggacctgccgcgcaaattcaagatcagcatcaccgccacccccgagctcgaaggcattcacctcatcaacgacatcggttttctggcccatgaggtcgatggcgaaattgggttcgacgtgtgggtgggcggtggcctgggcgcagtccctcacctcgccgagcggctgggcgtgttcatccggcccgatgaagtggtcgaagtgggccgcgccatcgtcggagcgtaccgcgaccacggctaccgggtgaaccgcaaaaagagccgcctgaagtacctcatcaaggacctcggcccggccaagttccgcgaaatcgtggaaaccgagtacctgggtcgcccgctgcgtgacggcccctccgcgccagtcgcccgcttcggcggcagcgacgtgctgggcgtcaacccgcagaaagacggcctcaactacgtggtgctgaccaccaccgtgggccgcatcacccccgaaaaggcccgccgcctggccgacctcgctgaacagtacggcaacggatacctgcgcaccaccgccttccagaacatgatgattcccaacgtgcccgacgagcacgtgggcgcactggtggccgagttgcaggagctggaactggcgcccaaggccaccctgcgcggcaccaccatcgcttgcaccggcacgcagttttgccgcctggcgcagaccgaaacgaaggcgcgggtggcgggcatgatcgacgtgctggagccgcgccacaacgacctcgacgtgccgttcgtcatcaacctgaccggctgctcgaacgcctgcacccgctatcaggtggccgacctgggcttcatgggcgcgctgcgggccaacaaggagaccggcggcgaggacgaggtctacaacgtccacctcgccggcagcatcgggcaggcgcagcgcaccggcaccaagctaaggggcatcgtgcccgccgagcggctgaccgagtacaccgaccgggtgatcagcgacttcaaggccaacaagacgccgggcgagagcttcgtggagtacgccgaccgggtgggcgccgaccgcttcgtgccggacaccgtgctggacggtggaaaggaactggtgaacgcgtga

SEQ ID NO: 47125 - DNA, 579 bp, Deinococcus radiodurans
gtgagcgcttccccctcactccccgcttcgcaaggccctctgccacagggggagagggttaataaggctggccgcgtcgtctggttcaccggcctctccggcgcgggcaaaagcaccctggcgacggccctgtttgaagaactgtcggcgcgcggcgaagcggtggaactgcttgacggtgacgctgtgcgcgagaacctgtccaaagggctgggcttttccagggaggaccgcgacaccaacgtgcgccgcatcgccttcgtggcggggctgctcgccaagcacggggtgacggtattggtcagcgccatcagcccctacgccgacacccgccgcgaggtgctcgccagcttgccgaacgcgctggaagtgttcgtggacgcgccgctggaagtcgtcaccgagcgcgacgtgaaggggctgtacctcaaggcgctcgccggagaaatcccgcactttaccggcgtctccgacccttatgaggcgcccgagaatcccgacctgcacctgcggactgaccgcatcagtgtggaggacggggtgcaacaactgctggggaggctgagtgatgaccgctga

SEQ ID NO: 47126 - DNA, 768 bp, Deinococcus radiodurans
gtgatgaccgctgaagtaagaactcccgaacagggcggcgggcctctaacgactgagccgcgcgcgccccgcagcgcaccgggacatgccgacgcttcggcccccgcttttggccccgaaaccgacccgcgcgacatcatccgctgggcgctggccgcgcaccccgacctgctgatgccgagtgcgttcaacctcaacggcgtggtgctgctcgacctcgcggcgcaggcgggctaccggggcgaagtcgtctttgtggacaccggctaccactttcccgaaacgctggcgacccgtgaccggctggaaagccgctaccctgagctgaccttcgtgaccctgaacgcgggcgcctcgccggatgacggacagacgccccccgatctctacgccagcgaccccgatgcctgttgcgcggcccgcaaggtggaccccttgcagcgctacttgaaggagcaaggtccctcggcgctcctcaacgcccgcagccgcgatcaggcgagcacccgcgccgacatcccctttgtggaggaaggcggcgcccggcgccgggtcaacccgctggcccactggacccgcgagcagctcgaggcctacgccgccgagcacgacctgccggtcaacccgctgtacttcgacggctttctgagcatcggctgctggccctgcacccgcgccgtgaaacccggcgaagatgcccgcgccggacgctgggcaggcaaaggcaagaccgaatgcggactgtggcagggcgagaacaagttgtaa

SEQ ID NO: 47127 - DNA, 1164 bp, Deinococcus radiodurans
atgacgaccttccaaaccgctcccgtcacccttcccacgcctctgggcggttcgctggtgcgccgcatctggcggcccggtcaggacttcgaccccgctgaactcgcgggccggccccggctggagctgagcagccgcagtctcgccgacctcgaaatgattgcgacgggagcctactcgccgctcactggctttgtgggcgaggccgattacctcagcatcatcgagcacttgcggctggcggacggcacgccctggagcctgcccatcacgctgccggtcacggcggagcaggcagccgggctgagtggccgggtggttctgacccacggcggcgagccggtcgggaccctcgacatcgaggaaaagtatgccgcccagaagagcctcgaagcccgtgaggtctaccgcaccgaggaggaggcgcaccccggcgtggcggcgctctacgcccagggcgacgtgtatctggccgggccggtcacgctgttcgaggtgccgcgcggcgagtttccccgcgcccaccgcacccccgccgaggtgcgcgaggtgatcgaggcgcgcggctggcgctcgaccgtcgcctttcagactcgcaaccccatccaccgcgcccacgagtacctgcaaaaagtcgcgctggaactggtggacggcctgctgctgcacccgctggtcgggcagacgaaaggcgacgacgtgcccgccgagacgcgcatggaagcctacgaggttctgctgcgcggttactacccgcaggagcgcacgctgctgagtgtctaccccgccgccatgcgctacgccgggccgcgtgaggcgattgtccacgcgctgagccgccgcaactacggggccacccatttcatcgtgggacgcgaccacgccggtgtcgggagctactacggcacctacgacgcgcaggagattttcaacacctacaccgccgaggaactgggcatccgcattctgaagttcgagcacaccttctattgccagagctgcggccaattggtcagcccccgcacctgcccgcacgactcctcgcaccacctcgtactgagcggcaccaaagtgcgcgagaagctgcgtgccggggagaacctgccccctgagttcacccgccccgaagtggccgaggtgctgaggaaggcctatacccgttaa

SEQ ID NO: 47128 - DNA, 1365 bp, Deinococcus radiodurans
atgaccgccacccaagccaaaccccgtcagcccgacctcaagacctccctccccggccccaagaccgccgaaatcatggcccgtgaccaggccaccctctccacgtcctacatgcgcccataccccttcgtgcccgactttggtaagggcgtgtggctcaccgacgtggacggcaacaccatgctggacttcttcgcgggcattgcggtgtccaccaccgggcacgcccacccgcatgtggtgcaggcggtgcagcggcaaatcgagaaattcacccacgtctgcctgaccgactacccgcaggaaatcaccaccagcctcgccgagcgtctggtcaagcatgtcgagcgtccgggcgaaaagtggcgcgtcttcttctccaactcgggcgcggaggcggtggaagcggcggtcaagctcgcccgcaaccacaccgggcgtcagcacatcatctcgacgatgggcagctttcacgggcgcacctacggcgcgattacgctgaccggctccaagacgaagtacaagcgcggctttggcccgctgctgcccgccgtctcgcacgtgccctaccccaaccccttccgtccgccgctcggcagcacgcccgaaaattgcggtcaggccgtcatcgaccacatcgaaagcctgttcgtggggattttgcccgccgacgaggtggccgccatcatcgtggagccgatgcagggcgaaggcggctacatcgtgccgcccgccgatttcctgccggggctgcgcgccctgtgcgacaagcacggcatcatgctcatcttcgatgaagtgcaggcgggcatgggccgcaccgggaagatgttctcgttccagcattttgacgtgcagcccgacatcatcacctcggccaagggcatcgcgtcgggcatgccgctcggggcgctgctggcgaaagaaagcgtgatgacgtggcccgtcggctcgcacggctccacctacggcggcaacccggtcgcggcggcggcctcgcacgcgacgctggacctactcgaaggccaggtgaagcacgagggctgcggcgacagcctgatggacaacgccgcgcaggtgggcgatttcatcctgggcgagctgaaaggaatgcaggacgagttccccttcatcggcgacgtgcgcgggcgggggctctttatcggcatcgagttcgtgaagcccgacggctcccccgacggcgccctgcgcgaccaggccagcatgatgatgtttgaaaagggcctgctcaacctggactgcggcgaagcggttatccgcatcagcccgcctctcatcctgacgcgcgaggaagcggcgacggggttggacatcatgcgcggggtgtttcaagaactgaaataa

SEQ ID NO: 47129 - DNA, 1581 bp, Deinococcus radiodurans
atgtccaccctcttagacggcctgcttcccttccagcacgaaccctacttcgactttgccgaccccgctgtggccgaggcgcaaaccgccgcctacgcgcaggcccgtcagaaatacgccggacagacctttccgctgctcgtcggcgggcagcaggtgaagggcgacggcaccttgaccgtgaccaatcccgcgaccggcgaacagctctggcacttccagaacgcgacggcggcgcaactcgatgaggcggtcagggccgccaacgaggccttccagagctggcgcttttccgaccccctgcaacgcgcgagcatcttcttgcgggccgcgcaactgctgcgctcgcgccgcatggagctgaacgccgtcatgagcctcgaaaacggtaaaaactgggccgaggccgacggcgaaatcgccgagtgtgtggaccactgcgaggtgttcgcccgcgaaacgctgaagtgggcgcagggcaaacccgtctatcccatgcccgacgagcacgtgaccaccgtttacgagccgctcggcgccgtcgccgtcatcagcccctggaactatccgagcgcgattccgctggggatggccctcggcgcgctggcggcgggcaacacggtgatttggaaacccgcgagcgagacgccgctctcgtcctggctgctcattcgcctgctgttcgaggccgggctgccgcgtgactgcgttcagttcctcaccggaagcgacgatgtgctcggcgacccgctggtggaccacaaggacgtgcggatggtcgccttcaccgggagccgcgaaatcggctgccgcatctacgaacgggcggcgaaggtgcagcccggccagaaattccttaagcgcgtgattgccgaaatgggcggcaaggaccccaccgtggtctgcgctgatgccgacctagacgccgccgccgctggcatcgtcgcttccaccttcggctacagcggccagaagtgcagcgcgtgcagccgcgtcatcgctgaggcaagcgtgtacgacacactgcttgaaaaggtcaagacgctgaccgaagcgctgaaggtgggtttgcccgagcacaacgccgccgtcggcccggtcatccaccaggggagcgccaaccgaattcggcagtacatcgaaaacggcaaagggacggcccgcctcgtctgcggcggcggagaaatggaggtggcagacagtggcgaggcgagcgccaactacatccagcccaccatcttcgccgacgtggacgcgaaagacccgctgtttcaggaggaaattttcggcccggtcctcgccttcgctaaagccgacgactggcggcacgcgattgacctcgccaacgattcggactacggcctgaccgccgccttttattcgcgcgacccccacaaactgaccgaggcgcggcggctgatgcacgtcggcaacctctatctcaatcgcaaatgcactggtgcgctcagtggctcgcattccttcggcggctacggcatgagcggcacgaacgctaaggtgggcggccctgattacctgttttggttcctccagacgaagacggtggcgcaaaagtattga

SEQ ID NO: 47130 - DNA, 1086 bp, Deinococcus radiodurans
ttgcggtcaggcattagcatacttttcatgaaggctcttatcccggcagctggcctgggcacccgtttgcgtcctctgacttttactcgccctaagccagtgctgcgagtggccggacaacccattattcgccacgcgattcggacgcttactgaagctggaatcaccgacatcggcatcgtggtttctgatgtgacgcgtgacgagatccagcatgcggtgcgcgagattcgtgatgtaaagctcacactgatcaatcaacacgatcagcttggcttaggtcacgccgtcctgactgcccgtgaatgggtaggacaagacgacttctgtgtttatctcggcgataacctttttgagtttggtgctcgtcctttcattgagagctttcatcagaagcacccggcagccctgatcgccctcgtcaaggtggctgatcccacagcttttggagtggctgagctcgacggtgagcaaatcactcgcctggtcgaaaagcccaaagacccgcccagcaacttggctgtcgcgggactgtactgctttacgccgcagatttttgaggtactcgacgtgatgcccccctctgcgcggggtgaatatgaaatcaccgacggcatccagggcctgatcgaacggggtcagacggtggtcggtcagagggtcgagggctggtggaaagacacgggtcgcccggcggacctgctggacgccaaccggctgctgctcgagcaaatcgaaaccgatgttcaaggcgatatggaaggctcccgcatgaccggccgcgtaatcgtgccggcctcgtcgaaggtgctgcgcagcaagatcgtgggccctgtcatcatcggtgaggatgtgattattgaagacgcttacatcgggccttttaccagcatcgggcggggaactgtgattcgcaacgccgagatagagcacagctcggtggacagtggggttgtcattgagaatgtgcagactcgtctgcaggattgcctgatcggcgtcaaagcccaggtgcgtgggggccggacacttcccaaaacccataagttgacgatcagtgatgccagtgtagtcgagttggcctga

SEQ ID NO: 47131 - DNA, 1095 bp, Deinococcus radiodurans
atgactcaaggcaaccaaccctctgacaaacagcagtggaagtctcttctcgtgaccggcggctgcggctttatcggtagcaacttcgtgcgctactggttgggacagcatcccgagagcaaggtcgttgtctacgacaagctaacctacgccgggcgcaaagaaaatctgcatgatctatgggataaccctgcgttgtcgctggtggtcggtgacatcggcgatatggatttagtgcgccgaacctgtcaggaaaatgatgtcgacttgatcgtcaacttcgcggctgaaacccacgtggatcagagcattctggggccgttggtctttaccgaaaccaacgtgcgcggtacccatgtgctgctcgaagtcgcccgtgagctgggcatccgcctgcatcacatcagcaccgacgaagtgtacggccacatcaaggacgggcatcagagcgtcgaaaccgatgaacttgcgccccgtagcccttacgcagcgagcaaagcagcagccgaccaactggtgcaggcgtatgcgattacctacggtatccctgtaaccatcacgcgcggggccaataacgtggggccttaccagtatccagaaaaagccgtgccgctgttttccaccaatgcaattctgggtgagccgctgcccgtgtacggcgatggccagcagatgcgcgactacgcccacgtttatgaccactgcaccgggatcgaaacggtgctgctcaggggaaatattggcgaggtctataacgttggcactggtcgcgaaatgaccaacctggaaatggtggacatcgtgctggagacactgggcaaggatcatagcctcgtcaagcatgtgaccgaccgtcccggacacgaccgccgttactccatgaatgtagacaaactgcggagcctgggttggcagcccaaatacgatcccaaacaggccgtggctgaggcggccaggtggtacgagggtaaccgctggtggtgggaaccgattcgcagcggcgagttccgtgagtactacaaccggcagtatgccgggcgtctcgccagtgcggagcctgctgcggcccaatctactgaggcaaagcagcaatga

SEQ ID NO: 47132 - DNA, 1422 bp, Deinococcus radiodurans
atgcctatcaaattcggaaccgacggctggcgcgacatcatcgctgaggactttaccttcgaaaatgtgcggacggtggcgcgggctcatgcccaggtattgcggtcgtcaggcgcccgctcggtggcggtgggcttcgacacccgcttccagggacaggcgtttgccagagtggtggctgaggtgatggccgcgcagggactcgacgtctggctggcacaggactatttgccgacgcccgcactgtcgtttgcggtggttcatcacggtgcgggaggcggcgtcatgatcaccgcgtcgcacaacccaccgcagtacagcggctacaaaatcaaaggaagttatgggggcagcgccaccccagcagtcgtggcgcaggtcgaggctgcgctggcgacggcggaaagctacgatggcccacgcggcgagataaggcccctcgacatccggcaggcgtactacgagcagctcgaccggcagcttgatttggagaccttgcgcgagtatcgaggcaaagtcatccatgacccgatgggcggcgcggcctgcggctggctgaccggttacgcccagcacgcgggccttcagctcgaactggaggagatgcacggacgccccgaccccctgttttacggggtcaaccccgagccgatccctcagaacctcggtgaattgacggagaggttgacgcgcgaaagtgcgcccaccctcggcgtgatcaccgatggggatgccgaccgggtcggggcgatcacggcaggcggccatttcttcaacagccaccagattttcgcggtgctgatcaagcatctctatggccgtggtgttcggggccgggtggtcaagaccgtctcgggcagccgagtgatcgaactgctggcggaaacactcggtctggaactgctggaaacgcccgtcggcttcaaatacatcaccgacgcctttctggaagggcagcaagacgagagcaaagcggtgctcatggggggcgaagaatctggcggcctgtcttcacgcggacacattcctgaacgggacggcctgctcaacagcctcctgatgatcgaagcggtggcggcgagcggtcagagcctcgacgagttgttcgccgaaattgagcgtgaggtaggctttcgtcatgtctacgaccgtgctgacctgcacctgagcgaggctttcgacaagtcggcactgatgcaggcggcgcagggataccgggaagtcgcgggtcaggcggtgactggaatcaaaaccaccgatggcgtcaaactggcgctcgcgggcgacgcttcagtaatgttccgcgcttcgggcaccgagccggtggtgcgcgtttatgtagaggcgcaaacgccggagatggtacaggctgtactgaccgaagctgtgcagcgagttcgcagttttgaccccatgtcctga

SEQ ID NO: 47133 - DNA, 1386 bp, Deinococcus radiodurans
ttgccttgctgggggcctttccccgctctttttggctgtccagcgggtcagttgcggcccccgcgccgggtcaggcaggtcgccgacgcagggagcacctgccctagaatagagatcatgcctccaacttcagatcgtgacgtggtcatcgtcgctgccgttcgcacacccatcggggccattcgggggtcgctcgccaccgtgcgccccgacgacctcgccgcgctggtgatccgtgaggtcgtggcccgcagcggggtgcccgccactgaaatcgaagaagtcatcttcggctgcgccaaccaggccggcgaagacaaccgcaacgtcgcccgcatggccgcgctgctcgccgggctgcccgaaacggtggccggcgtgacggtcaaccggctgtgcgcctcgggcctcgcagcggtgaacatggccgcccgcgccattcgcaacggggacggcgacgtgtacgtggtgggcggcgtcgagagcatgacccgcgctccgctgagcatgcccaagggcagcgcggccttcgccaacggcaacgtgaccgcctacgacaccaccctcggctggcgctaccccaacccggcgatggaagcgctctttcccctcgaagcgatgggggagacggcggaaaacatcgtggggcgcagccgcgagggggcttacgcaggcggcgaaatcacccgcgagcagcaggacgccttcgcgctggagtcgcagcgccgggcggtggcggccatcaacgcgggcaagttcaaggacgagatcgtgccggtggaaatcaagggccgcaagggcgtgaccgtgttcgacaccgacgagcacccgcgcatgaaaaaaggtgccgagagctacgaactggcgaccgatccggacacgctcgccggtcttaaaccagctttccgcaagggcggcagcgtgacggcgggcaacgcttcgggcctcaacgacggggcggcggcgctggtgctgatgagcgcggagcgggcacgcgccctcggggtcaagccgctggcccgctgggtgggcggcgcggcggcgggcgtcgaggcgcgggtgatgggcctgggtcccattcccgccacccgcaagctgctggagcgcaccggggtgcagaaggacgacctcgacctcattgaactcaacgaggcgttcgcggcgcaggccctcgcgtgtatgcgtgaactcgacctcgaccccgagaaggtcaatgtcaacggcggtgccgtcgccctgggacatcccctcggcatgagcggggcgcggctggtcgttgccctgacccacgaactcgggcggcgacaggggcgctacggcctggcgacgctgtgcgtgggcgtcgggcagggggaggcggccctgatcgagcgggtcgcggagtga

SEQ ID NO: 47134 - DNA, 903 bp, Deinococcus radiodurans
atgtccggctctgagggcactgacctgccgcgcgtgctggtcgtcggcagcgccaacctcgacttcgtgaccaggctgtcgcacctgcccgcgcccggtgaaaccgtactgggcgagtcgtacaccaccgcgcccggcggcaagggggcgaatcaggcggtggcctgcgcccgcgccgggggagcagtcgccttctgcggggcgctgggcacggaccccttcgccgaaccgctgctcgcctcgctgcgcgaaagtggggtgcaggactggactgtgcgcgcatctaccccgacaggcgcggcctttatcagcgtgtcggaggcgggcgaaaactgcatcgcggtggcgtccggcgcgaatggcacgctgcgccccgagcaactgcccccgctgaccggggtgggttggctggtgctgcaactcgaaatcccgctggagaccgtgcaggccgccgctcaggcggcgcgggaggcgggcgcccaggtggtgctcaacgccgcgcccgcccggacgctgccccccgaactgctgcggctggtggacgtgctcatcgtcaacgagggtgaattgcggacgctgatcggggccaccgacctgcgcgcaggcgtgcggcaggcccaggcgagtggcccgcgcacggtggtcgtcaccctgggagaacgcggctgtctagcactgagcggcgacgactggaccgagctgccggccctgcccgtgccggtgcgcgacacgaccggcgcgggtgacactttcgtgggcgtgctcgtcgcagcgctgagccgaggagagccgttcgccgctgcgctgcgctgggcggtggcgggcagtgccctcgcctgcacccgtgagggcgcccagccggcgatgccagggcgagaggagattcaagcaaatctggggtaa

SEQ ID NO: 47135 - DNA, 2187 bp, Deinococcus radiodurans
atggaagctcacggcacccggctcagctatttcgtggagggcatggactgcgccaactgcgtcgcgcgggtcgaaaagatggtgggcggcctgcccggcacgggcgaggtgaaaaccagctttacccggcagacgctcacgctggagcttgacgagacacagacgtcccgcgccgcgctggaaaaaaacctgcgcagcctgggctacgggccgtcgctgctgccggaccgggacgcgccgcagacgggcgaaggggcccacacacacgaccacgccgaccaccagcacgcgggtcacagccacagccatgaccccgccgaacagggtaagccctggtaccgcaccgggcaggggcaactggtggtcgcgtcgggcgtattgctggcgctggcgtgggtgttcgggcggttcgagccggcgtgggcgcagtgggggtacgcggcagccgccctgcttggcgcgtggccgctggcgaaaaaggcgtgggcgagtgtgcgcctcggcgaccccttcagcatcaacctgctggtgacgctcgcggccatcggggccgtcgccatcgggcaggccgccgagggcgcggtcgtcgtgtttctctttgcagtgggtgagctgcttgaaggcgtggcggcaggccgggcgcgggcgggcatcgccacgctggcggcgctggcacccaaaacggcgctgctggtcgagccaggcggcgtgcgcgaggtgcccgccgacacgctgcaagtcgggcaaacggtgcaggtcggccccggcgcccgcgtgcccgccgacggcaccatcacggcggggcagtcgagcctggacgacagcccggtgaccggcgaaagcgtgccggtgagcaaaggccccggcgaccatgtctacgccggcagcatcaacaccgacggcgtgctgaccgtgcgggtggaccgcgccgccgccgacaacaccatcgcccgcatcattcatctggtggaggaagccgagagcagcaaggcgcccaccgcccgcttcattgaccgcttttcgcgttggtacacgcccggcgtggtggcggtggcggccctgaccgccgcgctcccgccgctgctgctggggcagccctggtatccgtggctgtacaagggcatcgcgctgctgcttatcggctgtccctgcgcgctggtgctgagcgtgccggcggccatcacctccggcatcagcgcgggcacgcgccggggcctgctcatcaagggcggcgccgcgctcgaaaccatcggcagcgtgcgaaccatcgccttcgacaagaccggcacgctgacgagtgggcgcccgcgcgtcaccgacgttttggccgacaacccggcggaactgctgcgtctcgccgccgccgtggaaacagggagcagccacccgctcgcccaggccatcaccgctgaggcgcaggcgcgtgggctaaccgtcccggcggccagcgaagcccgcgccctccccggtcagggggtcacggcgctggtcgaaggccgccccgtgcaggtcacgtcgcccattttcgcggccagtcaggcgacgctgagtgccgagcagcaacagaccgtcgccacgctggagcagcaaggccgcacggtagtcgtggggcttgacgggggccgcgtcctggggttgattgccctgcgcgacgaaccccgcgaggatgcccgcgaagcgctggcggagctgcgccgcctcggcattcgcccgctgatgctcaccggcgacaacgcccgcaccgggcaggccgtcgccgccgacctggggttggacgtgcaggccgagttgctgcctgccgacaagctgaacatcattgacgaattgcgcgcccagggcggcgtggcgatggtgggcgacggcatcaacgacgcccccgcgctggcccgcgccgacgtgggcatcgccatggggagtggcaccgatgtggcgctcgaaaccgccgacgcggcgctgctgcgcgggcaggtgcagggggtgggcgaactcgtgcagctctcgcgcgacacgctggcgaacatccggcaaaatgtcgccttcgcgctgggcctcaaggccattttcctcgtcaccacgctgctgggctacaccaacctgtggatggcggtcctggccgataccggcgccaccgccatcgtcaccgccaacgccctgcgcctgctgaactggaggccgcgccatgcctga

SEQ ID NO: 47136 - DNA, 1293 bp, Deinococcus radiodurans
atgtccaacgtcttttaccgttccagcaagccctaccccgtcgccgtgcgtggggagggcgtttttctttatgacgacgcgggccgccgttatctcgacggctcctcgggagcgctcgtcgccaacatcgggcatggccgcgccgaggtgggggagcgcatggcggcgcaagcggcgcggctccccttcgtgcacgggtcgcagttttccagcgacgtgctggaggagtacgccgggcgactggcccgctttgttgggctgccaaccttccgtttctgggcagtgtcgggcggttcggaggccaccgagagcgcggtgaaactggcgcggcaataccacgtcgagcgcggcgagccggggcgcttcaaggtcatcacccgcgtgccgagttaccacggcgcctcgctgggcagtctcgcggcgagcgggatgggggcgcggcgcgagctgtataccccgctgatgcgcccggaagcctggcccaagctgcccaagcctgacccggcacggaacggggccgaggacgccgagggcctgcgcgccctgctcgaacgcgaaggaccggagaccgtcgctgcgttcatggccgagccggtggtgggggcctccgacgcggcgctcgctcctgcccccggctactacgagcgggtgcgcgacatctgcgacgaggcgggcatcatcttcatcgccgacgaggtgatgagcgggatgggccgctgcgggtcgccgctggcgctctcgcgctggagcggggtcacgcccgacatcgccgtgctcggcaaggggctcgccgccgggtatgcgccgctggcgggcctgctcgccgcgccgcaggtgtacgagacggtcatgggcggctcgggggccttcatgcacggcttcacctacgccgggcacccggtcagcgtggcggcgggcctgagcgtcctcgacatcgtggaacgcgaggacctgacgggggcggcgaaggagcgcggggcgcaactgctcgccgggttgcaggcgttgcaggcgcgctttccgcagatgatgcaggtgcgcggcaccgggctgctcctcggcgtggtgctcggtgacctcgctaccgggcaggcgttcgagacgccgggcatcgcttcacgtatcggtgcggcggccctgaagcgcggcctcatcacctaccccggcagcggcgccgagccgaatggccggggtgaccacctgctgctcgggccgccgctgagcatcacggctgccgaggtggacgaactgctggccctgctcgccggggcgctggaggacgtgctgggctga

SEQ ID NO: 47137 - DNA, 1488 bp, Deinococcus radiodurans
atgaccgctgaacctcaagtttcccctgcgcccaccccgccgcccgccgcgcccctgctggttcgtgaccgcctgtttatcggcggggaatgggtcacgccctgcggtcagggcaccctggaagtcgtcaattcggccaccgaagaagtcatgggcacggtgcccgaaggcacgccggaggacgccgagcgcgcaattctggccgcccgcgccgccttcgactcgtggtcgcagacccccgccgaggagcgggccgctctgctggagcgcatcagccggggcctgaacgagcgccagagcgaaattgccgcgctggtcgcgcaggaagtcgggatgccgttcgtgctcagcaacgtgattcaggtggggctgcccgccgtcaccttcatgtcgatggccgaggaaatccggcagctgcccgccgaggaaacgcttgccagttcactgctgctgcgcgagccggtgggcgtggtggcggccattaccccctggaactatccgctgcaccagattgccgccaaggtcgctccggcgctcgccgctggctgcacggtggtgctcaagcccagcgaagtggcgccgctcaacgccttcgtgctcgccgaaattatcgaggcggcgggcgccccggcgggggtgttcaacctcgtgaccggcaccggcccggtggtgggcgaggtgctcgccgcgcaccccgaggtggatatggtgtcgtttaccggctccacggcggcgggcaagcgcgtgagcgaactcgcggcgcgcaccgtcaagcgggtcgccctcgaactcggtggcaagagcccgtacctgattctggacgacgccgacctgagcggtgaggcgctggtgcaggccgtcatgaacgggattcagggctgttacctcaactccggtcagacctgctcggcgctcacccggatgctggtgccgcgttcgcgtctgcccgaagtcgaagcggtcgcgcaggcggtcgtttcacaggtgaaggtcggcagccccttcgacgccgcgaccaccctggggccgctggtgtcggacgtgcagcgcgagcgggtgcgcggccatatccggcagggcgtggccgagggcgcgcggctgatcgcgggcggcgccgagtcgccagaggggctggaacgcggctactacgtgcagcccaccatcttctcggacgtgacgccggagatgaccattgcccgcgaggagattttcgggccggtgctcgtcattcagccttacgaggacgaggaagacgccgttcgcatcgccaacgccacccactacgggctggcgggcggcgtgtggtcgagtgaccgcgagcgtgccgtgcgggtcgcccgccgcctgcggaccgggcaggtttcgatcaacggcggcgccttcaacccggtggccccttttggcggctacaagcagtcgggcaacggacgcgaattcgggcggctgggcctggaggaatttatggaggtaaaggccctccagttttga

SEQ ID NO: 47138 - DNA, 1044 bp, Deinococcus radiodurans
ttgacgcgcctccgagtgtggagtaggttgggtttgttacacggtgtgtggttagcgaaactgcggcccacacccagtcgttcaccggctgctttcgtggagccgcccggtgaacttgcctcccttccacgtggtgcaagacaggagagcagcatgagcatcaagacagttacggtgtgcggcagcggcgttctcggttcgcaaatcgcttttcagaccgcttttcacggcttcgacgttcacctctacgacatcaacgacgccgccatcgccaaggcccgcgaaacgctcggcaagttgcaggcccgctaccagcaggacctgaaggtggacgcccagcagaccggcgacgcctttgcgcgcatcagctttttcaccgacattgccgaagccgtcaagggtgtggacctcgttatcgaagccattcctgagaacatggacatcaagcgcaagttctacaaccagctaggtgaggtggctgacccgaacaccatcttcgccaccaactccagcaccttgctgcccagccagttcatggaagaaaccgggcgccccgagaagttcctggcgctgcacttcgccaacgaaatctggaagttcaacaccgccgaaatcatgcgcacgcccaggaccgatgacgccgtgttcgacacggtggtgcagttcgccaaggacatcggcatggtggcgctgcccatgtacaaggagcaggccggctacatcctgaatacgctgctggtgccgctgctgggcgccgcgctggaactggtcgtcaagggcatcgccgacccgcagacggtggacaagacctggatgatcgcgaccggcgcgccgcgtgggccgttcgccttcctggacgtgatcggcttgaccacgccctacaacatcaacatggcgagcgccgagaccaatcccggcagcgccgccgccgccaaatacatcaaggaaaactacatcgacaagggcaaattgggcaccgcgaccggcgagggcttttacaagtaccccaatccggccttcgagagcgccgacttcctgaaataa

SEQ ID NO: 47139 - DNA, 1575 bp, Deinococcus radiodurans
atgattttggaccgagatttaaacctggagcagttcatttccgtcgtgcggcacggcgaacaagtcgagctgtccgctgccgcccgcgagcgcattgccagagcccgcaccgtcatcgaacaaatcgtggagggcgacacgcccatctacggcgtcaacaccggcttcggcaagttcgagaacgtgcagatcgaccgttctcaactcgcgcagcttcagcacaacctgatcgtgtcgcacgccatcgggatgggcgagccgctgcctgctgaagtggtacgcggcatgctgctgttgcgggcgcagtcgctgtcgctggggcattcgggcgtgcgcgtggaagtggtggaactattgcttgcactcctcaacgccgacgcgctgccggtcgtgccgtcgcagggcagcgtgggcgcgtcgggcgacctcgcgccgctggcccacctcgccctcggtttgatcggactgggcgacatcgagtatcagggacaggtgcgccccgccgccgacgtgctggccgaactcgggctgagtccggtgcagttgcaggccaaagaggggttggcccttatcaacggcacgcagctgatgggcagcctgcttgcgctggcgctgcacgacgcgcaggtgctgctggggacggcaaacctcgccgccgccatgacggtggaggcccgctacggctcgcaccggccctttcagcccgacgtggtgggcctgcgcccgcaccccggcgcgctggcggtggccgccgagctgcgcgaatttctggccggttccgagattgcgcccagccacctgaccggcgacggcaaggtgcaggacgcctactcgctgcgggcggtgccgcaggtgcacggggcgacgtgggacgcgctagcgcaggccgagcgtgtgctggccgttgagttcgcctcggtgaccgacaacccactgatttttcccgagacgggtgaagtcgtttccggcggcaattttcacgggcaaccgctggctgttaccatcgacgcgctcaaggtcgcggtggccgaactcggcagcatttccgagcggcgcaccgagcaactgctcaacccggcgctctcgggcctgccggcgttcctgacgcccaatggcggcctcaacagcggtttcatgatcgcgcagtacacgtccgccgcgcttgtcagcgagaacaaggtgttgagccatccggcgagcgtggattccattcccaccagtgccaatcaggaagaccatgtcagcatgggcgcccacgcggcgcggcagctgcggcagatcgtggcgaatgtgcagaccgtcctgagcatcgaactgctgtgcgcggcgcagggcctcgacttccagcaattgcgggcgggacgcggcgtacaggcagcgtatgaatatgtccgcaccttcgtccccacgctgaccgaggaccgctacttccgccctgacttgctgcggctgcgaggtgagctggtcagtggcgagctgctgcgggtcgcgcaagcggcggacacgcaggccccagcgcccgccaagttgcccgacagcggcgacgaggaccgcgacacgacctcacggcactaa

SEQ ID NO: 47140 - DNA, 915 bp, Deinococcus radiodurans
atgagcgggccggcccacctgccctacggcggcattccgaccttcgcccgcgccccgctggtgcaaccggacggcgactggcaggcggacgtggccgccctcggcgtccccttcgacatcgccctcggctttcgccccggcgcccgtttcgccccgcgtgcgctgcgggaggcgagtctgcgcagcgtgccccccttcaccggtctggacggcaaaacccgcttgcagggcgtgacttttgccgatgcgggcgacgtgattttgccctcgcttgaaccccaactcgcccacgaccgcatcaccgaggcggcgcggcaggtgcgggggcgctgccgggtgccggtgtttctcggcggcgaccactcggtgagttatccgctgctgcgcgcttttgccgacgtgcccgaccttcacgtcgtgcagctcgacgcgcacctcgacttcaccgacacccgcaacgacacgaaatggagcaactccagcccctttcgccgcgcctgcgaagccctgcccaacctcgtccacatcaccaccgtcggcctgcgcgggctgcgcttcgacccggaggcggtggcggcggcgcgggcgcggggccacacaatcattccgatggacgacgtgaccgccgacctcgcgggcgtgctggcccagctgccacgcggccagaacgtgtatttctcggtggacgtggacggcttcgaccccgccgtgattcccggcacgtccagccccgagcccgacggcctgacctacgcgcagggcatgaagattctggcggcagcggcggcgaataatacggtggtgggcctcgatttggtcgaactcgcccccaacctcgacccgacgggccgcagcgaactgctaatggcgcggctggtgatggagacgctgtgcgaggtgttcgaccatgtctga

SEQ ID NO: 47141 - DNA, 1050 bp, Deinococcus radiodurans
atgactcctgacgcctccgctgcccctgccgaacccctgatgctgcgcgagatgcgcgaggcgcccgctgtggtccgccgtttgctgaacgagaaccaggacgcggtggcccggctcgctaacgccatacgggagcgccagcccgcctacgccgtgaccatcgcccggggcagcagtgaccacgcctgcacggtgctcaaatacgcgctggaaacgcagctttcgctgccggtcgcctcgctggggccgagcgtgcacacgctctacggagcgcggctggaccttgccggagcgctggtcattgccgtctcgcaaagcggcgcgagccccgacgtggtggaaaacgtgcggatggcgcgcgaaggcggcgcgttgaccgtcgccctcgtcaacgtggaagacagcccgctcgctgaggccgccgagttcaccctgccgctgcgctgcggcccggaaaaagcggtggcggcgacgaaaagctatctggcgagcctgtgtgccttcctccccgtgcttgccgagctgaccggggacgaagcactgaaacgcgctctggacgcgctgccggagcaactggcgcacacactgaccctggaagacgcggcccacgaacttgccgggcgctaccgctttgccgacaacctgctgattctggcgcgcgggcaccactacggcgtcgcgcaggaagcggcactcaagctgaaagaaacctgcggcattcacgccgaggcgtacagcgccgccgagttcagccacggccccaagcggctgctggccgaggggttgccgctgctgggcttcgcgtccgccgacgccgcctgggaggcgacccggcaggcttacgacgacctgcgcgcagcgggcgccgacctgcggctgctcgggccggtggcgggcgccgacctgcccacgcctctgggcggccacccgctgaccgacccggtgacgagcacgctggcgttttacctctttgtggcgcatctggcgctggaacgcggcctcgaccccgaccggcccccgctgctgagcaaggtgacgaagactcgctga

SEQ ID NO: 47142 - DNA, 1248 bp, Deinococcus radiodurans
atgacgatgttcgacaccaccccccgcgcccaggacctgcgcgagcggctgctgcgcttcatggacacctacatctaccccaacgaggccgaatttcaccgccaggtcgagtccggcgagcgctgggcgccggtcgagctgatcgaggaactcaagcccaaagcccgcgccgagggtctgtggaacctcttcctgccgcctgcgagcgaccccgagggcaagttcggtgccgggctgaccaacctcgaatacgcgggcctgtgcgaaatcatgggccgggtgtggtgggcgcccgaagtgttcaactgcaacgcgcccgacactggcaacatggaagtcattgcccgctacggcacgcccgagcagcaggagcagtggctccttcccctgctgaacggcgaaatccgctcggccttctccatgaccgagccgcaggtggcgagcagcgacgcgaccaacatcgaggcgcagattgtgcgtgatggcgacgaatacgtcatcaacgggcgcaagtggtggtcctcgggcgcgggcgactcgcgctgcaaggtcagcatctttatgggcaaaaccgacccgcaggccccccggcacctgcaacagtcgatgattctggtgcccttcgacgcacccggcgtcaaaattgagcgtgctctgcaagtcttcggcttcgacgacgccccgcacggccacatggaaatgagtttcgacaatgtgcgcgtgcccgtgaccaatatgctgctcggtgagggccggggttttgaaatcgcccagggccgcctggggccgggccgtatccaccactgtatgcgtctggtggggcaggccgagcgcgctctggagctgatgattgagcgcagtgcgcagcgtatcgccttcggcaaaccgctcgccctgcaccagcacacccgcgaattgatcgcccagagccgcatggagatcgaccaggcccggctgctgacgctcaaggccgcgcacaccatggatactgtgggcaacaaggacgccaagggcgaaatcgccgccatcaaggtggtcgcgccgaacatggccctgcgcgtgattgaccgtgccattcaggtctacggcggcgcaggcgtgtgccaggacactccgctggccatgatgtacgcgcaggcccgcaccctgcgcctcgccgacggccccgacatcgtgcacaccgaaacggttgccaaggaagaactgcgccgtcagggcgtggacctgcgggcgctcagcaagcgctga

SEQ ID NO: 47143 - DNA, 777 bp, Deinococcus radiodurans
atggccctgaaagaactgttcgacctgtccggcaaagtggcgctcatcaccggtggctcgcgtggcctcggcctgcagatggccgaagcgctcggcgagtacggcgccaccgtggtgctcaccgcccgcaagcaaaacgaactcgacgaggcgaaggcgcacctcgaagggctgggcgtcaaggcccacgtctacgccaacgacctcggcaacttcgagagcatcgacccgctcattgcgcaaattcatcaggaagtcgggcccatcgacatcctcatcaacaacgccggggccacctggggcgcaccgaccgccgagcatcccttcgacgcctggatgaaggtgatgaacgtcaacgtcaacggaacgttcctgctcacccagagcgtgctcaaccgctgcatgttgcccgccggcaagggccgcatcatcaacgtggcgagcgtggcgggcctcaagggcaactcgccgcagatgatgcccaccatggcttacaacacctccaagggcgccgtggtgaactttacccgcgccctggcctccgagctggcgcccaagggcatcaccgtcaactcgatttgccccggctactttcccaccaagatgacgcgcggcaccctcgccgccgccgagcaagccatcatgagccacacgccgatgggccgcctgggcaccgaccaggacctcaagggtctcgccgtgctgctttccagcgacgccagcgcctacatgaccggccagaacatcgccgtggacggcggcatcaccgcgatatga

SEQ ID NO: 47144 - DNA, 1575 bp, Deinococcus radiodurans
atgacccagcccaatccaacccagcccagtccgacgcagcaaaaccacgacctcgcccggcagctccgcgaaagccgcctgagcaggggccttcagcacttcatcggcggcgagtgggtggacgcccacagcggcaagaccttcgacgcgcactcgccggtggacaacgactttctggtgaaggtggccgagggagacgccagcgacattgaccgggccgcaaaagccgcccacgacgccttccagacgtggcgcgaggtgagcggggccgagcggcgcaagattctgcataaggtggccgacctgatcgagaagcgcgcacaggaaatcgctgtgctggaaagcgtggacaccgggcaggccatccgctttatgaagtcggcggcggcgcgcggggccgagaacttccggttttacgccgaccgcgcgccgggcgcccaggacggccagagcctgcccgcgcccggctttatcaactactccattcgccagcccatcggcccggtcggggtgattacgccctggaacacgccgttcatgctgagcacctggaaaattgcgcccgcgctggctgccggctgcacggtggtgcacaagcccgccgagtggtcgcccgtaagcgccacgttgctgaccgaaatcatggacgaggctgggctgccgggaggggtgcacaacctcgtgcacggcttcggcgagagcgcgggcaagtcgctgaccgagcacccgctggtcaaggcggtggccttcgtaggcgagacgaccaccgggagccacatcatgcggcagggggccgacacgctcaagcgcgtgcacttcgagctgggcggcaaaaacccggtggtggtcttcgacgacgccgacctcgataaggcgctcgacgccgtggtgttcatgatctacagcctcaacggcgagcgctgcacgtcctccagccgggtgctgattcaggagggcatctacgacgaattcacccgccgcattgccgagcgcgccgcgaacatccgggtgggcgacccgctcgaccccgacaccgaagtcgggccgctcgttcacccgcgccacttcgagaaggtgatgtcgtacttcgagtgcgcgcggcaggaaggcgcgaccattgccgccgggggcgagcgcgtgggcgaggccggaaatttcgtgcgcccgacactgtttaccgccgcccgcaacgacatgaagattgcccaggaggaaatcttcgggccggtgttgaccgccatcccttttaaggacgaggccgacgcgcttgagctagcgaacgacgtgaactacggcctggccgggtatctgtggacgaacgacctcacccgcgcccaccgcttcgcgcacggcctggaggcaggcatgatctgggtcaacagtgaaaacgtgcggcacctgcccacgcccttcggcggcgtgaaaaacagcggtatcggacgcgacggcggcgactacagtttcgagttctacatggagacgaagaacatcgccatctcgctggggacgcacaaaacggcgaagttgggtgtggggcaggctccggcagtgggcaagaaagaggctggagaatga

SEQ ID NO: 47145 - DNA, 543 bp, Deinococcus radiodurans
gtgtttccgatgacctcatcttctgcgcccacagacctcgaccgtcaggtgctcgaatttttgcaacgcgcttttgaagtcgcccgtgccggcgacgccgccgaactgcgcgtgatgctcgaccagggcctgccgctcaatgtccgcaatcagaagggtgacaccctgctgatgctcgctgtctaccacagccatctcgacgcgactcggctgctgctcgaacgcggcgccgacgcctctatcgccaacgacatgggccagacgccgctgcaagccgccgccttcaagggcgagctgccgatggtgcaactgctgctcgaccacggtgtagacgtggaaagccgcgggccgacgggccgcaccgccctgatgttcgcggcgatgtttgcccggctcgacattctggagttgctgctggagcgaggcgccgacctacaagcgcgggacagcgcgggcaccagcgccctcgacgccgcccgcaccatgaacgcgcagccttcggtgacgtggcttgaagaacggctggcccgcagctcgggttga

SEQ ID NO: 47146 - DNA, 2319 bp, Deinococcus radiodurans
gtggctgactttcacttcgctcttctcaaaggaaggtggctcatggctcccaaacgtaccctctccaccccgctgtctcttgacgacgcccagaagcaggtcgacgacctgagcaaggcccaggacctcagtgccaacaccaccgaccccggcaccaccctgactgacaacatggggcacgtcgtcagcgacgaccagaactcgctgcgggcgggcgagcgcggcccgaccctgatggaagacttcctcttccgcgagaagatcacccacttcgaccacgagcgcatccccgagcgcgtggtgcacgcccgtggcgccggtgcgcacgggtacttccaactcgacaagagcctggaaaagtacacccatgccaaggtgctgaccgaagtgggcgtcaagaccccggtgttcgcgcgcttttccacggtggccggctcgcgtggctcggcggacacggcgcgtgacgtgcgcggcttcgccgtgaagatgtacaccaaggaaggcaactgggacatcgtgggcaacaacattccggtgttcttcattcaggacgctatcaagttccctgacctgatccactcggtcaagcccgagccgcacaacgagattcctcaggcggcctcggcgcacgacaccttctacgacttcatcgccgagacgcccgaagcgatgcacatgctgatgtggattcactccgaccgcgccattccccgcgcctacaacatgatggaaggcttcggcgtgcacaccttccgtctggtcaacgcccagggcaaggctcacctcgtcaagttccactggaagccggtgctcggcgtcaagagcctggtgtgggacgaagcgcagaagattgccggtaaggacgccgacttccaccgccgcagcatgtgggagaccattgaccagggcggcacgctggaatgggacttcggggtgcaagtgttcaccgaagaagaggcgatgaagtgggacttcgatgtgctcgacgccaccaagatcgtgcccgaagacctcgtgccggtacagcgcgtgggcaagatggtcctcgaccgcaacgtggacaacttcttcgccgaaaccgagcaggtcgccttcatgacccagaacgtagttcctggcattgatttcaccaacgacccgctgctccagggccgcaacttctcatacctagacacccagctttcgcgcctgggcagccccaactggcaggaactgcccatcaaccgccccatcatccgcgtgagcaacaaccagcgcgacggccacatgcgccacaccatcaacaagggccgcgtggcgtacttccccaaccagatggccgccaacaagccggcccaggcgggcgcggcgggcttcgtcacctaccccgacaaggtggaaggcaccaagctgcgcgtgcgcgccgagagcttcagcgaccactacggtcaggcgcgactgttctggaactcgatgagcccggtggaaaaggagcacatcgccaagtcgctgcgcttcgagctgagcaagtgcgaaacccgcgacgtgcgtgtgcggatgctcgggcatctggcaaaaatcaacgaggtgctcgccgcgcaggtcgccaagggcctcggcgagaagttgccctccacgagcgacgccaaacccggcggccagcaggacagcgcctctgaaactgcgctgctcgctgcggccatctcgcccaccaccgcttcgggcgggctgcaaaaggccaagggcctgagccaggaagaaggccagcccaagagtgccaagggccgcaaggtggccgtgctcgtcgccgacggtgtggacgctgccggagtgaaggcgctgcaagacgccctgaagaaggccgatgtcaagtacgacatcgtggcgccccacctcggtgaaatcgcttccggcgtgatggcgacggcgaccctgtccaacaccgaccccgtggtctacgacggcgtggtcgtggcgggcggcgcggcggcggtgcgcgaactcgcgcagcaccccgaaagcttcaacttcgtggtggggtcttaccgccacgccaagcccatcggcagcctcggcgaaggcgccgaaatcgtgaccggctcgggcatcggcaacgtgctgcgccgcgtggccgccgactcccccgccaaggacggcgccacggctccggtgcagaacctctccgaagtcgcgggcgtgcgtctcgcagcgggcgaagggggcgccaagctcgccgccctcggcgtaatcgtgggccaggacaagggggccagcgccgccgccgacagcttcgtgcaggcgctcgccgagcaccgcttctggggccgtccgcagctctaa

SEQ ID NO: 47147 - DNA, 1365 bp, Deinococcus radiodurans
gtgtccattcaatcatttgaggaaaaatcggtccccatgacggtggaccgcgtgctggacgacctgggcctgggccgcttccagtggaagctgctcgccatctgtgggctgacctgggccgccgacgcgatggaggtgctcctgatgggcttcgcgctgcccggcatcagtgcggcgttcgagttgcccaaaggctcgcccgccgcgacgatgctgctcaccgcgacttttgcggggatgctgttcggggcgtggttctgggggtatctggccgaccgggtgggccggcgcagcgtgtttctgacgacggtggcgctcggcgtggtcttcgggctggcgggggccctagcgccgacgctgacgtggctactcgtcgcccgctttctaacgggcttcgccatcggtgggacgctaccggtggactactcgatgatggccgagttcgtgccgacagcgtggcgcgggcggtttctggtgtatctggaaagtttctgggcggtgggcacggtggtcgtcgccgcgctcgcgtggtgggtcagtaccgcttttgcccccgccgagggctggcgctggctgctggggctggccgcgctgccggggctggtcggcctgattgcccgcatcggcattcccgattcgccgcgctcgttgctggcgcggggcgaagaagcgcaggcccgcgccgcgctgcaaaaagtcgcgcaggccaacgggggcacgctgcccgccgcgccgctcgcgcacccggagcagccgccgcgcgtgtcgcccgcccagcttttccggggcgtcctcgcccggcgcacgccgctgctgatggtgacgtggtttgggctgagcctgggctactacggcattttctcgtggctgccgagctttctgcgggcgcaggggctggacctcggcgcggtgtaccgcagcacgctgctgctcgcgctcgcgcaggtgccggggtatctgctcgccgcttacctggtggaaaagattgggcggcgggtcacgttggtcggctttctgacgctcggcgcggtgggggcgtacctgttcctgctcgcccacgacgcgaacacggtgctgctgacctcggccctgctctctttcgcgctgcttggcgcctgggggtcgctgtacgcctacacgcccgagctgtttcccaccccgctgcggaccaccggcatgggactggtcagcggggtggcccggctcgccagcgtggtgtcgccgagcatcggggccatgctgctcaccggcaacctgacgctcgcgctgaccgtgttcgccgtgtgcttcgcgctcgcagcgctggcggcgtggggcatcggggtggaaacgcgggggcaggcgctggcggaaacggcagagtaa

SEQ ID NO: 47148 - DNA, 1581 bp, Deinococcus radiodurans
atgagtgaaatgagccgcagaaatttcctggggatggtcggcatggtcggtggggccgccgccgcctaccagatgatgaacacgatgggcctcgccgcgtcctcgacctacaccaagccgcaacttaccggcggcggcaagggcaagagcgtgctgattctgggcgggggcttagccggcatggcgagcgcctacgaaatgcagaaggccggctacgacgtgcagattctcgaattcaacgggcgcgccgggggccgctgctggaccattcgcggcggcgacgaatacaccgagctcggcggcttcaagcagacctgcgagttcgaccggggcctgtacatcaaccccggcccctggcgcattccctgccaccatcacgcttacctccactacgcccgcgagttcggggtcaagctcgaaccgttcatcatggaaaactggaacgcctacatccaccgcgaggggaaaaatggtcagcaacccacgcgggtgcggcaggccgaggcgcgcaccgacatgcaggggcacgtggccgaactgctgaacaaggccgccagccagggcaacctcgacaccggcctgaccaccgaggacaaggaaaaactgctcgaagcgctgcacgaatggggttttctcaacaaggacgggcgctacgtcaagagcctcgaaacgagcacattccgtggctatgaccgcgaccccggtgcccgcctcgaacccggcacgccctcgcagccgatcggcctcgacacgctgcttgagcgccggctctggagcgacctgaaccagggtatgtggtacgagttccgcagcaccatgttcgagccggtcggcggcatggatgccatggcccgcgccttcgagagccgggtgggccgcttcatcaagtaccgcgcccgcgtgaccgaaatcaagcaggacaccgacaaggtcaccgcgacctacgtggacgccgacggcaccaccaagaccgcgagcggcgactactgcatctgcaccattccgctctcgatcctcagccagatcaagctgaccggcgtggacaaggacctcgccgaagccatcaagaaggtgccctacgcctcgagcttcaaggcgggcgtgcagtacaagcgccgtttctgggaacaggacgatgacatctacggcggcatctcgtacaccgacctgcccaaccagctcatctcctacccctcgaacaactacttctcgaccggcaagggcgtggtcctcggcgcctacatgttcggcaccgacgcggtggtcatgagcggcatgtcgcccgaagagcgcctgaagaaagtcgtggagtacaacgcgcagctgcaccccgccgccgccaaggagttcgacaacggcgtgaccgtgggctggcaccgcgtgccctggactctcggctgctacggcctgtacaacgccgacacccgcgagcgctactaccctaccctctgcgcccgtcatggccgcatgatgctggccggcgagcacacctcctactggaacggctggcaggaaggcgccctgctcgcggccaccaccgccgtgcaggaaatgcacaagttcgcgagcagtcaggcctga

SEQ ID NO: 47149 - DNA, 1743 bp, Deinococcus radiodurans
ttgcccccaggagaagaccccatgagccacaagaccctgcccctgaccgaccactacgacgtgaagcgcggcgaagacggccaccgctacctgcgcccgctggtgcgcggcttcaacctcacccgcattccgctgctcaacaagggcaccgccttcaccgccgaggagcgcgaagcccacggtctcgacggcctgctcgcgccgcaggtggacagtctggaagtgctcatcgagcgcgcctaccgcgagttctccaagcgcggcgcggcgctggaaaaacacgtctacctgcgcaacctgcaagaccgcaacgaggtgctgttctacgcgttgctctcccatcacgtcgaggaaatgctgcccatcgtctatacccccacggtgggcgacgcggtcaagaagttcagccagatctaccgctacccgcgcggcctgacgctcagcacccgcaccatcgagcgtgccgagcaggccctcgccaacgtgccgctcaacgacgtgcggattatcgtggcgaccgattcgagcgcgattctgggcatcggcgaccagggcttcggcggcatggcgatcagcatcggcaagctcagcctctacaccgtggcgggcggcgtggggccggacaagacgctgcccgtcgaactcgacgtgggcacgggccgcgccgacctgcgcgaagacccccactacctcggtgtcaagcacgagcggctgaccggcgaggaatatttcgcctttatcgacaagtttgtcgaggcgaccattcagcgctaccccaaggcgattattcagtgggaagacttttccaaggacgcggccttcgaggtgctcgcccgctaccgcaaggtcgtcccgagcttcaacgatgacattcaggggacaggtgcggtggtgctcgccggggtgctcaacgcctgccgcatcaagggcgaggcgctcaaagaccaagtggtcgtcgtccacggcgctggggcgggcggggccggggtcgccgccgctatccgcgaggggatgcaccgcgaagggctgtcccccgacgagattgcccgccgcgtcttcgtcctcgactcgcgcgggctgctcaccgacgaccgctccatggaagcctacaagcaggcgctggcgacgccccgcgccctggtgagcggctggagcggcaccgacctgctgggcgtggtgcgcgaagccaaagcaaccgtgctgctcggtctctccggtgtccccggcaccttcgacgaggacatcgtgaaggccgcgctcgccaacacgccgcgcccgttggtctttccgctgtccaaccccaccgcgcactccgaggcgctccccgaagacatcctgcgctggacggacggcgcggccatcgtcgccaccggcagccctttcgcgccggtcgagcacggcgggcagacgcacgaaatcgggcagggcaacaacgccttcatctttcctggcctcggctttggcgccattctggcccgcgtgcgcgagatcaccgacgagatggtcaccgaggccgcctacgcgctcgccgactacactcaggcgcaccatccgggccgcacctacccgccggtcaacgaactgtcgcaggcgagcgtgcaggtggcggtggcggtcatcaagcaggccatcaaggacggcgtcgccaccgaattcagcgtgcggcgtctgagcgacggcgaactgcgggccttcgtggagcgcaagttttgggaacccaagtttttgccctaccactcgtga

SEQ ID NO: 47150 - DNA, 1968 bp, Deinococcus radiodurans
ttgagtctggtacactcaacttatggcaccgccgtgtgccccaactctgttctctccgctgttttccccttttcgcctctggaggcacccctgttgaagcggctcaatccctggatcatcgtgctcctcgtgctcggcctgttcctgatgttcacgaacctgcccggcagtgggcgctataccgtcaactacaacgaattcaagtcactgctgaaccagggccgcatcgagcgcgtcaccgtgcgcgaggacgtggcgaccgtgctgctcaaggagcgcggccaagtcagcgtcatcaccccgcagggtcaggccaccaaggacggcgtcgagagcctgatcgtgcgcctgcccggcaaccaggccacgcctgactccggcctgattccccagctcgaagccaagggcgtggactaccgctttgaggcgccgagccagtggttcgccatcctcatcaacttcctgccgctcatcttgctgttcgggatgatgtacttcttctttgcccgctcgcagggcggtcagggcggcgtcatgcagttcggccagagcaaggccaagaagtacggcaaggaaaaccgcgtgcccaccaagttcaccgacgtggccgggcacgaggaagccaagcgcgagctgatcgaagtcgtggacttcctgaaaaacccggccaagtaccaccagatcggcgccgagattcccaagggcgtgctgcttgtgggccctcccgggacgggcaaaacgctgctcgcccgcgctgtagccggtgaagccgacgtgcccttcttctcggtgagcgcctcggaattcatggaaatgttcgtgggcgtgggcgccagccgtgtgcgcaccctgttcgaggacgcccgcaagagtgcgccggccatcatcttcatcgacgaaatcgactccatcgggcgcaagcgcggtgcgggtatcggcggcgggcacgacgagcgcgagcagacgctcaaccaaatcctctcggaaatggacggcttcgacaagtcgagcagcgtgatcgtgctcggcgcgaccaaccgccccgacgtgctcgaccccgcgctgctgcgtccgggacgcttcgaccgtcaggtgacgatcgacctgcccaacctcaaggaacgtgaggccatcctcaaggtgcacctgcgcaacaagccgctcggtgagggcgtggacgtgcccgaaatcgccaagagcacgccttacttctcgggcgccgacctcaagaacatcaccaacgaagccgcgctcgaagccgcccgcgtgggcaagaccaagatcgatatgagcgacttttaccgggcgctcgacaagatcaccctgggcctggaaaacagctcgctcaccatcagcgaacccgaaaagcgcgccatcgccttccacgaggccgggcacgccgtgaccgccgccgtgattccgggcagcgacaagctgcaaaaggtcagcatcatcccgcgtggccgggcactcggcgccgccttctatctgcccgaagagcaagtgctgatgagcaaggaacggctggaaaaccagctcgtcgtggcactcgggggccgcgccgccgaagaagtcttcgtgggcaccataacgagcggggccgccgacgacttccgcaaggcgaccaacatcgcccgcaagatggtgctggaatggggcatgggcgagaacttccgcaacatggcgctgcaaaccgacggcggcggtccggtgttcctcggcgaggacatgggcaagcccaagatgttctccgagcacaccgcgcaactcgtagacgaagatgtcaagcgcatcctcgccgccgcttacgagcgctcgcgccagatcgtctccgactacaagcaggcgatgcaggaagtggccgacgccctgctcacccacgaactcatcaccggcgacgtggtgcgcgacgccgtggcgcgggtgggcggccagtcggtggccgtggcgcctgctccgaccgtctaa

SEQ ID NO: 47151 - DNA, 1734 bp, Deinococcus radiodurans
gtggtcatgacctataccgattccgaagagctctacctcgccgaactcagtcgccgccagcaagagagctggcccgctggccgcccccgcgtggccgagtatccgtttggcgagcggcccgtcaccgcgtacctgcacgagtgggcgacgcgccagcctgagcgcgccgctatcgagttttacgggcagaccctcacctacgccgaactcgacgacctgagcgaccggctggcgtcgtggctcgaagaacgcggcgtcttgccgggcgagcgggtcgccgtcttgctgcccaactgcccgcagttcaatgtggcttttcacggggtgctcaagcgcggcgccgtgttcgtgccgctcagtccgctggcgcggggcggcgagttgcagcacctgctcgacgaggccgaccccgccgccctgatcgtgctcgacgcgctgtggccggtggccgagccgcacctcgccgggcgcgccgtccgcgaagtgctgcacgtcggactggcggcgacgctgcctgacaggcccaccctgccgctgccggacttgctgcgggccgccgccgcgcaaccggcaggccagcacgacctgttcgcgctgctgcgcggggtcacggtgcgcccacaggccgagccggcgctcgattcgcccgcagtcatcaacttttccggcggcaccaccgggttgcccaagggctgcctgcaccaccaccgcgacctgatctacacctgcgcgtcctactgcgcggtggcggtggagcggagcgagcatccggtgtttctgagcttcctgccgcagttctggattgcgggcgaagacctcggcgtgctgtttccgacctttctgggcgcgacgctggtgctgctgacgcgctgggacgcccaggcttttttgcgggcggtgccgcactacggcgtaacgatcacgaccctgctggtggatcaggtggacgaactgctggagcatccggcggcggcgcagaccgatttttcctcgctgcggcaggtgaacgccgtgtcgttcatgcgtaagctcaaccccgactaccgccgccgctgggccgcgttgaccggcagtctcattgccgaggcgagctacggcatgaccgagacgaacacttgcgacaccttcactaccgggtttcagaaggatgacttcgacctgctcagccagccgactttcgtggggctgccggtgccggggaccgagttcaaggtgtgcgacttcgaaaccggcgagctgcggcccttcggcgaggagggcgaactgtgcgtccgcagtccggcggtctacaagggctcgtggcgcgagcgccgcgccgagtcaccgggcggctggctgcacaccggcgacagcggcatcatcgacgagcaggggctgctgcactacctgggccggcggcgcgagatgatcaaggtgagcggcatgagcgtgtttcccggcgaactggaaatgctgctgggccggcacccggcggtgagcggcgtcggcgtgctggggcgcccgcacgagcggcgcggcgaggaagtcgtcgccttcgtcgtgccgcgtccgggccacgacctgtcggccgcagccctgagcgagtggtgccgcgccgagatggcggcctacaaggtgcccaccatctatttcctcgacgagttgcccctgacggccaccggcaaggtggacaaaaagcagctgttgccgcgcctggccgagctgacgggcgaggcgccgggcggcggcgcatga

SEQ ID NO: 47152 - DNA, 1317 bp, Deinococcus radiodurans
ttggccaccggtaggaccggcccggcactccctcccggcagagcgcaccctgccgggagctgtcatgcccagtcgcctcgctcccctcacccgtctcagcaaaccggtcagtcccacagggacaaaaactctagactgaagaatgtcagcttatttgcaccgggcgggcggcaccccgcgtccaggacgctgcccttgacggcctacctcatctccgccgccaccgccgtgcccggcaccgcttatccccagaccctgattcgtgacctgcttcgggcgcagccgcaaatggaccggctggcacagcggctcattcccagtgccttcaatgcctcgggcatcgacacccgctacagcgtaattcccgattacctgggcgcgggcggcccctttttcgacgccgtgagcgggcagatgctctcgccgggcaccggcctacgcaacgaggtctacacccgcgaggtcacgccactgtttatcgatgccgggcggcgggcactggagggcagcggactggcgccggaggacatcacccatgtcgtcacggtgtcgtgcacgggctttttcgcgcccggccccgattatctggtggtgcgggcgctgggcctgcccgccacgacccagcgctttcacgtcgggttcatgggctgctacgcggcgtttccggcgctgcggatggcgcgggccttttgcgacgccgacccgcaagccaacgtgctcgtcatctgcgccgagctctgcaccctgcacgtcaaggtgtcgcctgaccccgacgatatcgtgtccagcgcggtctttgccgacggcgcggcggcggtggtggtgagtgctcagcctcccgtcacgggtcggacggcgctgcgcttcgacgccttcgagacggcgctcaccccgcccgaccagggcgaaaaggacatggcgtggacgattggcgaccagggctaccagatggtcttgagcagctacgtgccgcgcctgatcgaaacccacctgcacggcgcggtggggccgctgctgcacacgctgccgggcgaactcgcgcaggcgggcgagcacatcgagcactgggcggtgcaccccggtgggcgcagcattctggacaaggtggaaggcagcctgggcctcagcgaaacgcagatgcacgcctcgcgtgaggagctgaggcgctacggcaacatgagcagcgcgacggtgctgtttattctgcgtgacctgctggaagaggtcagggacggcgaacgggtctgcgcgatggccttcgggccgggcctgacggtggaatcggggctgatgaccgcggtgggggcgagtgaatag

SEQ ID NO: 47153 - DNA, 1161 bp, Deinococcus radiodurans
atgttcgactatttcaagatgctcgacctcgtttcccccgacgagcgcgatatccacgccgccacgcgtaagttcgtggacgctgaaatcatcccgcacatcggtgactggtgggaacacgaatcggcccccacccgcgaactgatgcgcaagatgggctcgctggggctgctcggcccgaccacgcccgagcagtacggcggcgcgggcacgtcctacaccgcctacggcctgatctgctacgaactcgagcgcgccgacagcggcctgcgcagcgcggcgagcgtgcagggcagcctggtcatgcaccccatcaacgagtacggcagcgaggagcagaaaaagcagtggcttcccggcctcgcgtcgggcgaactcatcggctgcttcggcctgaccgagcccgacggcggctccgaccccggcgggatgcggacccgcgcccgcaaggacggcggcgattatgtcctcaacggcagcaagatgtggatcaccaacagcccgctcgccgacgtggcggtcgtgtgggccaaggacgacgaggacgtggtgcgcggctttatcgtcccgcgtgacgcaaggggcttttccacccccaaaatcggccacaagatgagcctgcgggcctccaccaccggggaaatcgtgctggaagactgccgcatcccggcggagaacctgctgcccggcagccggggcctcaaatccccgctgggctgcctcacctcggcccgctcgggcatcgcctggggcgcgatgggagcgctcgaaagcgtgctgacggccagcctggagtacgcgggcagtcgcaccacctttggccggcccatcgccgcgcgccagctcgtgcaggaaaaactggcctggatggcgacccagcactcgctcggcagcctgctcgcgtggcgcttggggaacctcaaagacggcggccagatgaactacgctcaggtcagcgtcgccaagggcaacaacgtgcgcgtcgcgctcgaaggtgcgcgcatggcccgcgagattcacggcggcaacggcatcaccaccgagtacccggtcattcgccacatgctcaacctcgaaacggtggacacctacgagggaacccacgacatccacaccctgatcgtggggcgtgacctgacggggcagaacgcgctggagtaa

SEQ ID NO: 47154 - DNA, 864 bp, Deinococcus radiodurans
gtgagcggcgaacccagttgccccttcggtggcccggcgcccgaacactccgccgagcaggcgcaccgcgatttcagccgctcgctgagctacggcgactacctgcacctcgacgagctgcgctcggcgcaccagccgatcaccgacgcccacgacgagcatctgtttatcgccattcaccatgtgtccgaggtgtggctctcgctcatcgtgcgcgagttgcaggcggcgatgagactgctcgacgccggcatcaccgacgcgccgctgaagatgctgacccgcgtggtccgcgctcaggaacagctcaccgccgcctgggacgtgctcaagacgatgacgcccgccgactacctccagtttcgcggcgcctttgggcaagcgtcggggtttcagtcgcaaaactaccgcatggtcgaattcctgctcggcaaccgcaactccacgctgctgcgcccgcacgagcaccgcgccgacctgcaccgccccctcgccgccgcgctgcacgcccccagcgtgtacgacctcaccctgcgcctcctcgccgcgcgggggctgccggtgcccgccgaggtgctgcaacgcgactacgcccagccttaccaaacgaacgaagcggtcctggcaagctggctgagcgtgtactgcgacaccgagacttactgggacctctacgaactcgccgagaagctggtggatgtggaggacaacttccggcgctggcgtttcaaccacctcaccaccgtggaacgcaccatcggcttcaagcgcggctcgggcggcaccagcggcgtgggctacctgcgcggggcccttgacgtggtgctgtttcccgaactgtgggacgtgaggacgcaattgtga

SEQ ID NO: 47155 - DNA, 1434 bp, Deinococcus radiodurans
atgactgccaccccccaagcgtccgcccgtcccgagcgtccctttgccactgtcaacccctacaccggcgaaacggtcaagacctttccctttttggagagcgccgaaattccggccctcatcgagcgcgccgaccaggcctaccgcgagtggggccaacgcccggtgacggagcgggccgcgatcatgcgccgcgccgccgagttgatgctcgagcgcactgatgaacttgccagcctgatcacgctcgaaatgggcaagctgctgcgcgaggccaagggcgaagtcgcgctcgccgccagcatcctcaactactacggcgagcagggcccgagcttcctcgaacccaagaccatcccggtgccgcagggtgaagccgccgtgctgcacgcgccgctgggcgtcctgctcggcatcgagccgtggaactacccgctgtatcaggtcgtgcgttttgctgcgcccaacctcgtcgtcggcaacacggtgctgctcaagcactccgaactctgcccacagtcggcgctcgccctcgaacaactgttccatgacgcgggcgtgccgcagggggcctacaccaacctgtttctgcggattgccgacatcgaacaggtcatcgcgcaccccgccgtacagggcgtgtcgctcaccggcagcgagcgcgccggggcgagcgtggccgaactggcggggcggcacctgaaaaagtgcgtgctggaactcggcggcagtgaccccttcatcgtgctcgacgccgaggacctcgacacgacggtcaaggcggcggccacggggcgcctgagcaacaccgggcaggcctgcatcgcggccaagcgcctgatggtcgtggacgacctgtacgacgagttcgtgtcccggctgggtcagaccttctcggccttcgtgcccggcgaccccgccgacccttcgacccgcctggggccgctgtcttccgaacaggccgcccgtgacttgcaggcgcaggtgcaagacgccatcgacaaaggtgcgaccgtcgtcgcgggcgggcagcgacccgagcatcccggcgccttcgtgcagcctaccgtgctcaccgacgtgacacccgacatgcgcgcctaccacgaggaactgttcggcccggtggcggtcgtctaccgcgtgcgcgacgaggacgaagccgtagcgctggcgaacgcttcgacctatgggctgggcggcgcggtgttcagcagcgacctcgaccgggcgcagcgggtggccgagcgcctcgacaccggcatggtctggatcaaccaccccacgtcctccgccgctgacctgcccttcggcggcgtcaaacgctcgggtttcgggcgtgagctgtcctcgatgggaatgctcgaattcaccaaccagaagctggtgcgcgctttcccgaccaagcaaaagcccgcgcaggtcgctggctga

SEQ ID NO: 47156 - DNA, 1548 bp, Deinococcus radiodurans
atgaccgtcgccgaacagcaaccgcagcaccagggctacgccaaccccggcacgcccggcagtgtcgtcaccttcaagaagcgctacgacaatttcatcggtgggcagtgggtgccgcccgtgaaggggcagtatttcgacaacgcttcgccggtggacggcaaggtgtttacccaggccgcccgctcgaccgccgaggacgtcgaactcgcgctcgacgccgcgcaccgggccgcgcccgcctggggccgcaccagcgtgaccgaacgcagcaacattttgctcaagattgccgaccgcatggagcagaacctcgagatgctggcggtcgccgaaacctgggacaacggcaagccggtgcgcgagacgctcgccgccgacctgccgctcgccatcgaccatttccgctacttcgccgggtgcatccgggcgcaggaaggcggcctcagccagatcgacgacagtaccgtcgcgtaccacttccacgagccgctcggcgtggtggggcagattattccctggaatttcccgctgctgatgggcgtttggaagctcgcgcccgcactcgcggcgggcaacgcggtggtgctcaagcccgccgaacagacccccgccagcatcatggtgctgatggaactgattgccgacctgctgccggagggcgtggtcaacgtggtcaacggcttcgggctggaagcgggcaagccgctggcgagcagtccgcgcatcgccaagatcgcctttaccggcgagacgaacaccgggcggctgatcatgggctacgccgcggacaacctgattccggtgacgctggaactcggcggcaagtcgcccaacatctttttcgacgacgtgatgatggaagacgacgccttcctcgataaagcggtcgagggcatggtgatgttcgcgctcaaccagggcgaggtctgcacctgcccgagccgggcgctgattcaggaaagcatctacgaccgcttcatggagcgggcggtgcagcgcgtggaggccattaccatgggccacccgctcgaccccggcaccatgattggcgcgcaggcgagcaccgagcagctcgacaagattctgtcctacctcgacattggccgcgccgagggcgccgaagtgctgaccggcggcgaacgcgggcagcgcgagggcctggaagaaggcttttacgtcaagccgaccatcttcaagggccacaacaagatgaggatttttcaggaagaaatcttcgggccggtgctcgccgccgccaccttcaaggacgaggccgaggcgctcgaactcgccaacgacacgctctacggtctgggcgctggcctgtggacccgcgacatcagccgcgcctaccgcatgggccggggcattcaggcggggcgagtctggaccaactgctaccacgtctaccccgcgcacgcggccttcggcggctacaagcagagcggcatcgggcgcgaaaaccaccgcatgatgctcgaccactaccagcagacgaagaacctgctggtgagctacagcccgaacaagatggggttcttctga

SEQ ID NO: 47157 - DNA, 1809 bp, Deinococcus radiodurans
atgaccccgcgttcaggccctcgcccggctgcttccgcgcgccgtgatgcccggcaacgcgacccccggcaattgcgccgcctgctcgcctacgcccggccctaccgcctgcccttcgtgctgggcgtgctcgccaccctgatttcgagcgggctgggactggtgtttccccggctgttcggtacgctgatcgacgcttcgtttctgaaggtgggcagcaccgacaccgggccgctcgaccgcaccgtgctgtcgctgttgggcattttcgcgctctcggcgtgcttcggggcggcgcaggcgtacctgctcgcgcgggtgggagcgggcgtggtggccgacctgcgccgggcgctgttttcgcatctgctgtcgctctcgccgcgctttttcggcaaccaccgcaccggcgacctgacgagccgcctcacctccgacgtgggcaccgtgcaggcggtgacgagcacggcgctcgcgcagctcgcctcgcaggggtttaccctcatcggctcagtgctgctgctggtgcagaccagcccgcgcctgagcctgctgaccctcgccatcattccactggtcatcggcacggcggtgaccatcgggcggcgcatccggcgggtcagccgcgaggtgcaggacgcggtggccgccgccaacgggcaggccgaggaagccatcagcggcgtgcgggtggtccagagctttaccgccgaggggttggaggaggagcgctacggccagggcgtgctcgccagtttccgcgccgcgctgcgccgggcccgtttgcaggcgctgatgaccggcgtcatgagcttcctgaccttcggggcgctcgcgctggtgctgtggttcggcgggcggcaggtcatgagcggcgcgctgacgccgggcaacctcgtcacgttcctgttctacgcgctgcaggtgggcggcacggtggcggcgctgaccggcgtgttcaaccagtttcaggaggcgctgggcgcgtcgagccgcattttcgagttgctcgacgagcgcagcgacctgcccgggcccgccgcgccgcggccgctctcccgcgccgagggccgggtgcgcttcgtggacgtggggttcacctatgccggggcgcccgccttgcaggacatcaccttcgacgtgcccgccgggcaggtggtcgcgctggtggggccgagcggcgcgggcaaaaccacgctggtcaacctgattccgcgcttctgggacgtgacggcgggccgggtggaggtggacggccacgacgtgcgcgcctacgccctggccgacctgcgccgtcaggtggggctggtgccgcaagaaaccctgctgttttcggggacggtggccgagaacatcctctacgggcgccccggcgcgtcgcaggccgaggtcgaagccgccgcgcacgccgcgcacgcccacgagttcatctgcgagctcgaaggcggctacggcgcggtggtcggcgaacgcggcgtcaagctctcgggcgggcagcgccagcgcgtcgccattgcccgcgccatcctcaaagacccgcgcatcctgattctggacgaggcgaccagcgcgctcgacaacgagtccgaggcgctggtgcaagcggcgctcgagcggctgatggtgggccgcacgaccttcgtcgtcgcgcaccgcctgagcaccattcgcagcgccgaccgcattctggtgatggacgccgggcgggtggtcgccgacggcacgcatgaggggttgatggcggcaggcggcctctaccgcgagttgtacgagttgcaattccggcagcagcaggaggcgcggcgctag

SEQ ID NO: 47158 - DNA, 1173 bp, Deinococcus radiodurans
ttgtcgcgcgcccggtgctgtcggcggctccctaccgcacgccggtgcgcggggtgtatctgtgttcgagctccacgcctcccggtggcggcattcacggcatgtgcggggtcaacgcggcacgaacggcgctggcagacgagttcggcttcaggaagtaaagccgccctcagccgggcaggtccacacaaaattcgcttaaggcccctgcaacccgccacgcccccagcttcggcacactgggcagcaggagacctcatgaccaacgacgacaagaccaagcaggccaatggccagcccgaaaccgccgccaccgagaacatgccgcaggaggtgcccgccgaaacccaggagcagcagcccggcagcgaagccgaaatgagcctggccccggtggtcatccgtgacgattaccggggcagcgacaagctgaagggcaaggtggccctcatcagcggcggcgacagcggcatcgggcgcgcggtggccgtgcattttgcccgcgagggggccgacgtggcgatcttgtacctcgacgagcaccaggacgcgcgggacaccctgaagatggtgcaggccgagggccgccagggcctgatcatcgctggcgacattggcgatcccaagttctgtcaggacgcggtggcgcaggtaatgaaggaactcggcaagctcgacattctggtcaacaacgccgccgagcagcacccgcaggaaaacctcaccgacatcaccccggagcagctcgaacggaccttccgcaccaacattttcggcatgttctacctgacccaggccgccctgccacacctgcaaaaaggcgccgtgatcgtcaacaccacctcggtcaccgcgtataagggcagccccgaactgctcgactactccagcaccaagggcgccatcctcgcctttacccgcagcctgtcgcaaaacctcgccgacaagggcattcgcgtcaacgccgtggcgcccggccccatctggacgccgctcattccctccacttttgaccagaagcgggtggccgagcacggcaaaaagaccccgctcgagcgccccggccagcccgccgaagtcgcgccgagctacgtgttcctcgcgtcggaggacagcagctacatcaccgggcaagtcctgcaccccaacggtggggacgtggtcaacggctga

SEQ ID NO: 47159 - DNA, 1008 bp, Deinococcus radiodurans
atgcctgatgacgctctccctggcctagtgccccgcattccgcacggcggcccatcgagtgccgctttcgtcggcctcgatttcagcgtcaactgcaatccctacggcccgaatccggccctcctcgctgctgtgcgcggcgccgaccacgcgcactatcccgatcccagctatctcggcgtgcgccggaggctggccgactggcacggcgtttctcccgacgaggtagttctcagcgtcggcgcatcggacctgctgcaccgcgtcgtccgcgcctttttgcctgcgggagacgtgctgctgagtcttcacgccccgttcggtgaactcgcccgcgccgcgcagttgcaacgggcgaaaattcacgtgatggacgaggtgcccgctgctctgccgccccgtacccgcctcgtctacgtggggcagccgcacaacccgacggggcgccgactctgcgcgccggaactagacattctggcgaacgcctgcgccgctgcccacgcgttgctggtgctcgaccttgcctacgcgccctttctgtcgctccctgttcaccatcacccattcaccatcaatgttctgtctcccggcaaagcccacggcctcgtcggagcgcggcccgcctacgctcttgcccgcgcggaggtcacggcgcggctggacaacctcgccccagcatggcacctcccggcgggcacggcggcgctgctcgcggccttgcccgccgcacaagatttcctgtccgagacgctgccccgcgtgcagaatgacgccgcagctctggcccacgccctgcgcgaatttggccccgtggaacgccgcggcacgccctttctgactctggaagtcggtgacgcggcggcagtcgcgcgaaaactgctgccactgggcatccgggtgcgtgactgcgcgagctacggcctgccggggcgggtgcgggtaagtacgcaggcgaacaagaatgaccggcggctcatcggcgctctccaggaggttctctatgggtaa

SEQ ID NO: 47160 - DNA, 2076 bp, Deinococcus radiodurans
atgaaggcaaacatgaaactgctggcgctgctgtgcgcactcggcagtggcgcggcgggggcggcgagcacgaacacgatgacgctggccgggacggaaatcaccaaccaggcgcaggccaccttcacggtcggcggcgccacgcagaccaccaactcggacgccgtcaagatcgtggtcaatgccgtgccgagctacaccatcaccaacgacggcaccgaggcgtcgccggcgtacaccagcaccgtcaacgtcaactcgaacgccacctacagctactcggtcaagaacaccggcaacacgccgattcaagtggcggtcggcgccaccgtgggcacgggcagcagcgccattacgcaggtgaactactcaggtgcggccaccggcaccgttccgaccaccggcgcggccaccatccagacaatcaccatcaaccctgatcagaccgtgacgctaacccagaccttcgtcacgcctgcggcgcccggcacctattatgtcaacccgactggcgtctccatgcagtacgccagcgtcgcggccaatccggacggctcggcgctgaccacggcgaccctcgaccagaccagcaataggaccgacgtgaacaacgtcaacaagacgacggtcctgaccaatgttcccctgctcggcagccccaccctgaccaacacggtggtgcccagctcgcccaaccccctgccgccgaccggcaccaccacgcccggcaccggcacgggcccggtgggctccggcaacggccccgccgagtccaccggccccgcctacacgggtatcggcagcaccagcggcacgcagcccccggtggtcgtggacgccagtggcaaccagtacgcctaccccaaggcggacgccgagaccgtcaaccccgacagcgtcaccatgacgaccatcatcaccaaccccaaccccacggcggcgacctatgaactggtgccggacctgagcgggctgcccgccggggtcacggtgacctttaccgacgcgaacggcaacccgctgcccgacaccgacggcaacgggcgaccggaagtgacggcggggcccaacggcggcaccgccacctacagggtcgtggtgacttaccccgacaccgagagcgccgccgccgtggccgggcccatcaggataccggtgggcgtagacggcaaccgcgacggaatcgtggacgcgaccgtgacctacaacgtgctgctgtccaacctgaagttcggcaacaccaacggcacggcgctgggcgtttccgacgtgccggtgacccgcaccgtcacgcagccttcggtgaccaccgccgtcgtgttcccgatggaccttttcaacgacggcgcctacgacggcaactacgcgctctcgggcagcactccgatcggcccggtgaagtactacgccaccaaccccgacaccgacggtgacggcgtcctgtcccccgccgaactcgcggcgctgcccgccgagatcgccagcaccggcgccgtgccggtcaagaccgagaagaccgtgtacgcggtggtcacgattcctgccggtcaggcccccggtgattacatggtcacgcagaccgccaccggctcgctcagcggcaccaccaagtcctttaacaccgacaaggtcacggttacttcgccgaacggttcgctgctcattgccaagcgggtcacgacgccgggcaccactacgcccagcctgaacgcgactgccaatccgggcgacgcggtgtcgtacaccgtgacggccaccaacaactacaacaccagcctctacggtctggtgctgcgcgaccccagcagcaacaacctgggcagcttcagcagcagcaacgtctttggcttcatcaagccgagcagcctgagggcaacggtcagcggcgtcagtggcgccacggtgctgtaccgcacgagcaacctgaacacctgggccgctcagcccaccgtggacgccaacaccacctgggtcgaggtgggcgtggacaccaacaacaacagccagatcgacagcggcgacgtattcccgccgaacgccgtaatcacgctgaccctccagggaaccgtcaagtaa

SEQ ID NO: 47161 - DNA, 2109 bp, Deinococcus radiodurans
gtgcactggagaacccaccccatggaacgctggatagaactgaacaacaaagtcttggccgggaatgtcgtggacacccagcacgacacggacgccctgcaagcctattttcaggaaaaagtcaacccgaacaccgtctttttccacgatctacgcgagaaaatccgttacctgaccgagcatggtctgtgggacgcccgcctttttgagcgctacagctctgaggacgtccggcaggtgtttgaaaaggcgtacggttacaagttccgcttcaaggcgtttatgggcgcctacaagttctattccgagtacgccggcatgacgcccgaccgctcgcgctggctggaacgctacgaagaccgcctcagcattacagcgctcgcccgctcggaacgcgtggacgaggcgctggaacttgttcaccacctcgtcaaccagacctttacgcccgccacgcccaccctaatgaactcgggcaaggcgaacacgggccggctggtgagttgctttctgcttcaggactgcaccgacaacctggattccattaccaagacgctgtcctttgtggccgaactgagcaaggggggcggcggcatcggcgtggaagccagcaatctgcgggcacggggcgaaagcctgcgcgggattcagaacgtcacgaaaggcgtgctgggcgtggcaaagatgctggacaacatgctgcgctacgctgaccaagcggggcagcgcccgggagccggggcggtgtacctcagtgtgatgcacgctgacttcagtgacctgctgaacgccaagaaaattgccaccgatgaggacgcccggctcaagaccctgagtatcggcgcaacgattcctgacatctttatggaaaaagtgcgctgcggcgaggatatttatcagttctacccgcactccttttttcaggaaacgggccgcgagttcacctctattgactggacgaaggaatatcaggcgctggcagataaccccaacatccgcaaaaagcgcgtgtcggcgcggcggcttctggaagatattgccgtcacgcagggcgaaagcggctacccctacctgctgtttgagggcaatgccaaccgcgccaacccgattccgaatgtggggacgatcaagatgagtaacctttgctcggaaattttgcagcccaccacgccgagctattttcacccttacggccaagagcaccgggacagaatcggcctggacgtgtcgtgcaacctcgcctcgctcgtcatcgagcagaccatgcacggcggcgacctcgggcgggtggtcggcgcggcgatccggatgctggacaacgtggcgcgctccaccagcgtccatgaggtgccggcggtcaagcgcgccaacgacgagatgcgctcgattggcctgggcgcgatgggcctgcactcctttctggcgggcaaggaactgatctacggctcgcccgaggcgctcgaattcgtggacgtgtttttcgctgccgtgcattaccacgcccgcaaagcgagtatggaaattgcccgcgacaccggcttcgtgttcagcggctttgaaggcagccgctatcagtcgggggaacactttgcgcagtatctggaacgcgactttgcgccgaggaggcccgaagtcgccgcactgtttgaagggcacaccctgcccacccgcgccgattgggaacaacttgtggaggacatcaaaacgcatggcctcgcccactctttcgtgatggcgattgcgcccaccggctccatttcctacgtctcgcacgccagcgccagcatcatgcctattactgagaaggtggaaacccgcaccagcaacaaggcgcggaccatctaccccatgccgcacctgtcggaagacaccgagtggtactacgaggaagcctacgacatggaccagcgccgcgtgctcgacaccgtggccgccgcacaaaagcatgtggaccaaggcatcagctgcacgctgttcctgccggcctcggccaccacacgcacgctgcagagctactacctgtacgcctaccgcctcggcatcaagacgctgtactacacgcgcttacgcaagacgaacgtgcaggactgcctgagttgcgtggtgtga

SEQ ID NO: 47162 - DNA, 1065 bp, Deinococcus radiodurans
ttgcgtggtgtgaatatccagcctgatcgagtgttcggttcgccccagccaatcaacaacgaggtgcccatgacccccttttccgccgccaactggtccgaacccgaagacaatttttcggccaccttttacgccaaatacacctcgcagctgtggttccccgaggaaattccgctgacgaacgacgcgctggcctggaagacgctgagtgacgaggaacgctggacgtacatccacgcctcagcggggctgaacgcactggacaccctgcaaggtgaggtggggatgccccggctgcgtgacctcgtggacgggcacattcgcaaggcgaccctgcagtttcagggcatgatggaagacattcatgcccgcagctacagcctgatgaacaagaccttcctgacagcgagcgaggagcgcgaggtcttcgagtgggtcaggacgcagccacaactccagcacaagattgccgtcattcagggcgtctaccgtgaccccgacgtgtccgacctcggagtatggaaaaaactggtggtgtcgtgcatgttggaaacggcgctgttctactcagggtttttttacccgctctacctcgccgggcaggggcagatggtgtcggcaggcgagattttcaatctcattattctggacgaggcgctgcacggcgtgtacgtcgcgctgctggcacaggagaaatttgccaccatgaacgcggcagagcaggccgacgctcaagcgtggtttgatgacaccttgcaggcgctttacagcaacgaactcgcctacactgagcagctttatgccaacgtgggtctgacaggagaagtcaagaaatttattcgcttcaacttcaacgtgctggccgacaatctggcgctgccccgccccttcggcgacgaggacatcaaccccatcgtgcaaaacggcattcaggcgcgggggaccacccacgatttcttctcggccaaggggagcagctacagcaagatgacggtggagccgctgaccgacgccgatattgagacgctctggcatgagcccgcgcaggtgaccgtccatgagtga

SEQ ID NO: 47163 - DNA, 1629 bp, Escherichia coli
atgaaaactcgcgactcgcaatcaagtgacgtgattatcattggcggcggcgcaacgggagccgggattgcccgcgactgtgccctgcgcgggctgcgcgtgattttggttgagcgccacgacatcgcaaccggtgccaccgggcgtaaccacggcctgctgcacagcggtgcgcgctatgcggtaaccgatgcggaatcggcccgcgaatgcattagtgaaaaccagatcctgaaacgcattgcacgtcactgcgttgaaccaaccaacggcctgtttatcaccctgccggaagatgacctctccttccaggccacttttattcgcgcctgcgaagaagcagggatcagcgcagaagctatagacccgcagcaagcgcgcattatcgaacctgccgttaacccggcactgattggcgcggtgaaagttccggatggcaccgttgatccatttcgtctgaccgcagcaaacatgctggatgccaaagaacacggtgccgttatccttaccgctcatgaagtcacggggctgattcgtgaaggcgcgacggtgtgcggtgttcgtgtacgtaaccatctcaccggcgaaactcaggcccttcatgcacctgtcgtggttaatgccgctgggatctgggggcaacacattgccgaatatgccgatctgcgcattcgcatgttcccggcgaaaggatcgctgctgatcatggatcaccgcattaaccagcatgtgatcaaccgctgccgtaaaccttccgacgccgatattctggtgcctggcgataccatttcgctgattggtaccacctctttacgtattgattacaacgagattgacgataatcgagtgacggcagaagaggttgatattctgctgcgtgaaggggaaaaactggcccccgtgatggcgaaaacgcgcattttgcgggcctattctggcgtgcgcccgctggttgccagcgatgacgacccgagcggacgtaacgtcagccgtggcatcgtgctgctcgaccatgctgaacgcgatggtctggacggatttatcaccatcaccggtggcaaactgatgacctatcggctgatggctgaatgggctaccgacgcggtatgccgcaaactgggcaacacgcgcccctgtacgactgccgatctggcactgcctggttcacaagaacccgctgaagttaccttgcgtaaagtcatctccctgcctgccccgctgcgcggttctgcggtttatcgtcatggcgatcgcacgcctgcctggctgagcgaaggccgtctgcaccgtagcctggtatgtgagtgcgaagcggtaactgcgggtgaagtgcagtacgcggtagaaaatttaaacgttaatagcctgctggatttacgccgtcgtacccgtgtggggatgggcacctgccagggcgaactctgcgcctgccgcgctgccggactgctgcaacgttttaacgtcacgacgtccgcgcaatctatcgagcaactttccaccttccttaacgaacgctggaaaggcgtgcaacccatcgcctggggagatgcactgcgcgaaagcgaatttacccgctgggtttatcagggattgtgtggtctggagaaggagcagaaagatgcgctttga

SEQ ID NO: 47164 - DNA, 1260 bp, Escherichia coli
atgcgctttgatactgtcattatgggcggcggcctcgccggattactctgtggcctgcaactgcaaaaacacggcctgcgctgtgccattgtcactcgtggtcaaagcgcactgcatttctcatccggatcgctggatttgctgagccatctgccagatggtcaaccggtgacagacattcacagtggactggaatctttgcgtcagcaggcaccagcccatccttactcccttctcgagccacaacgcgtgctcgatctcgcttgccaggcgcaggcattaatcgctgaaagcggtgcgcaattgcagggcagcgtagaacttgctcaccagcgggttacgccgctcggcactctgcgctctacctggctaagttcgccagaagtccccgtctggccgctgcccgcgaagaaaatatgtgtagtgggaattagcggcctgatggattttcaggcgcaccttgcggcagcttcgttgcgtgaactcggccttgccgttgaaaccgcagaaatagagctgccggaactggatgtgctgcgcaataacgccaccgaatttcgcgcggtgaatatcgcccgtttccttgataatgaagaaaactggccgctgttacttgatgcgcttattcctgtcgccaatacctgcgaaatgatcctgatgcccgcctgcttcggtctggccgatgacaaactgtggcgttggttgaatgaaaaactaccttgttcactgatgcttttgccaacgctgccgccttccgtgctgggcattcgtctgcaaaaccagttacagcgccagtttgtgcgccagggtggcgtgtggatgccgggcgatgaagtgaaaaaagtgacctgtaaaaatggcgtagtgaacgaaatctggacccgcaatcacgccgatattccgctacgtccacgtttcgcggttctcgccagcggcagtttctttagtggcggactggtagcggaacgtaacggcattcgagagccgattctcggccttgatgtgctacaaaccgccacgcggggtgaatggtataagggagatttttttgcgccgcaaccgtggcagcagttcggtgtaaccactgatgagacgctacgcccgtcacaggcagggcaaaccattgaaaacctgtttgccatcggttcggtgctgggcggatttgatcccatcgcccagggatgcggcggcggtgtttgtgccgtcagtgctttacatgccgctcaacagattgcccaacgcgcaggaggccaacaatga

SEQ ID NO: 47165 - DNA, 1218 bp, Escherichia coli
atgtcccccattgaaaaatccagcaaattagagaatgtctgttatgacatccgtggtccggtgctgaaagaagcaaaacgcctggaagaagaaggtaacaaggtactgaaactgaacatcggcaacccagccccgttcggttttgacgcgccagatgaaatcctcgttgacgtgatacgcaacctgcctaccgctcaagggtattgcgattccaaaggtctttactccgcgcgtaaagccatcatgcagcactaccaggctcgtggcatgcgtgatgttaccgtggaagatatttacatcggcaatggtgtatcggagcttatcgttcaggcaatgcaggcattgctgaacagcggggacgaaatgttggttcctgcaccagattacccactctggaccgcggcggtttcgctttccagcggtaaagcggtgcattatctttgcgatgaatcctctgactggttcccggacctcgatgatattcgcgctaaaattacgcctcgtacgcgtgggatcgttattatcaacccaaataacccaaccggcgcggtatattccaaagagcttttaatggagattgtggagattgcacgtcagcataatctcattatcttcgccgatgaaatttatgacaaaattctctacgacgacgctgagcatcactcaattgcgccgctggcacctgacctgctgaccattacctttaacggactgtcgaaaacgtaccgcgttgcaggcttccgtcaggggtggatggtgttgaacgggccgaaaaaacacgccaaaggctacatcgaaggtctggaaatgctggcttcaatgcgcctgtgtgctaacgttcctgcgcaacacgccattcagaccgcgctaggtggttatcagagcatcagtgaatttattacccctggcggtcgtctttatgagcagcgtaaccgcgcgtgggaactgatcaacgatattccgggcgtttcctgcgtgaaacctcgtggtgcgctgtatatgttcccgaaaatcgacgccaaacgctttaacattcacgacgatcagaaaatggtgttggatttcctgttgcaggaaaaagttctgttggtgcaagggacggcattcaactggccgtggccggatcacttccgcattgtcacgctaccgcgtgtcgatgatatcgagctgtctttgagcaagttcgcgcgtttcctttctggttatcatcagctgtaa

SEQ ID NO: 47166 - DNA, 669 bp, Escherichia coli
atgcctgaggaggcccgcgtgcggtgcaaaggttttctgtttgatcttgatggaacgctggtggattccctgcctgcggtagaacgggcgtggagcaactgggccagacgtcatgggttagcgccggaagaggtgctggctttcattcacggtaaacaggcgatcacctctctgcgccattttatggcgggcaaatccgaggctgatattgccgccgagtttacgcgtctggagcacatcgaggccacggaaaccgaaggtattaccgcgcttccgggggcaatcgccttactcagtcatttgaataaagcaggtattccgtgggccattgtgacttctggctccatgccggtagcgcgagcgcgccataaaatagctgggcttcccgcaccagaggtgtttgtaaccgctgagcgagtgaagcgcggaaaaccagaacctgatgcgtatctgttaggcgcgcagctgctggggcttgcgccgcaggagtgtgtggtggtggaagatgctcccgctggcgtgctttctggcctggcggcgggttgtcatgtcattgcggttaacgctccggcagataccccgcgcctgaatgaggtcgatttggtcctccacagtctggagcaaattactgtgaccaaacagccaaatggcgatgttattattcagtga

SEQ ID NO: 47167 - DNA, 648 bp, Escherichia coli
atgatcgatctctatttcgccccgacacccaatggtcacaaaattacgctgtttctcgaagaagcagagctggattatcgcttgattaaggtagacctggggaaaggcggtcagtttcgtccggaatttttgcgcatttcgcccaacaacaaaattccggcaattgttgatcattctcctgccgatggcggcgaaccgctaagcctctttgagtctggtgccattttgttgtatctggctgagaaaacaggactctttttgagtcatgaaacgcgtgagcgcgccgccacattacagtggttattctggcaggtaggcggactggggccgatgcttgggcaaaatcatcattttaatcacgcagccccccaaaccattccttacgctattgaacgttatcaggttgaaactcagcgtctttaccatgtactgaacaagcggctggaaaactcgccctggctgggaggcgagaactacagcattgcggatattgcctgctggccgtgggttaatgcctggactcgccagcgaattgacctagcaatgtatccggcagtcaagaactggcatgagcggatccgttcgcgccctgccaccgggcaggcactgctaaaagcacaactcggtgatgagcgttcggatagttaa

SEQ ID NO: 47168 - DNA, 1014 bp, Escherichia coli
atgtctgaaggctggaacattgccgtcctgggcgcaactggcgctgtgggcgaagccctgcttgaaacgctggctgaacgtcagttcccggttggggaaatttatgcactggcacgtaacgaaagcgcaggcgaacaactgcgctttggtggtaagacaatcaccgtgcaggatgccgctgaattcgactggacgcaggcgcagctggcattttttgtcgcaggcaaagaagctaccgctgcctgggttgaagaagcgaccaactcaggttgcctggtgatcgacagcagtggattgtttgctctcgaacccgacgtaccgctggtggtgccggaagtaaacccgtttgtactgacagattaccggaaccggaatgtcatcgccgtaccagacagtctgaccagccagctgctggcggcactgaaaccgttaatcgatcagggcggtttatcacgtatcagcgttaccagcctgatttcagcctccgcccagggcaaaaaagcggtcgatgcgttagcggggcagagtgcgaaattgctcaacggcattccgattgacgaagaagatttcttcgggcgtcagctggcgttcaacatgctgccgttactgccggatagcgaaggtagcgtgcgtgaagaacgtcgtatcgttgacgaagtacgcaaaatcctgcaggacgaagggctgatgatttcggctagcgtcgtccaggcaccggtattctacggtcatgcccagatggtcaactttgaagctctgcgtccactggcagcagaagaagcgcgtgatgcgtttgttcaaggcgaagatattgtgctctctgaagagaacgaattcccaactcaggtaggtgatgcttcgggtacgccgcatctttctgttggctgcgtgcgtaatgactacggtatgccggagcaagtccagttctggtcggtggccgataacgttcgctttggcggcgcgctgatggcagtaaaaatcgccgagaaactggtgcaggagtatctgtactaa

SEQ ID NO: 47169 - DNA, 1221 bp, Escherichia coli
atgaaacgtgcagtgattactggcctgggcattgtttccagcatcggtaataaccagcaggaagtcctggcatctctgcgtgaaggacgttcagggatcactttctctcaggagctgaaggattccggcatgcgtagccacgtctggggcaacgtaaaactggataccactggcctcattgaccgcaaagttgtgcgctttatgagcgacgcatccatttatgcattcctttctatggagcaggcaatcgctgatgcgggcctctctccggaagcttaccagaataacccgcgcgttggcctgattgcaggttccggcggcggctccccgcgtttccaggtgttcggcgctgacgcaatgcgcggcccgcgcggcctgaaagcggttggcccgtatgtggtcaccaaagcgatggcatccggcgtttctgcctgcctcgccaccccgtttaaaattcatggcgttaactactccatcagctccgcgtgtgcgacttccgcacactgtatcggtaacgcagtagagcagatccaactgggcaaacaggacatcgtgtttgctggcggcggcgaagagctgtgctgggaaatggcttgcgaattcgacgcaatgggtgcgctgtctactaaatacaacgacaccccggaaaaagcctcccgtacttacgacgctcaccgtgacggtttcgttatcgctggcggcggcggtatggtagtggttgaagagctggaacacgcgctggcgcgtggtgctcacatctatgctgaaatcgttggctacggcgcaacctctgatggtgcagacatggttgctccgtctggcgaaggcgcagtacgctgcatgaagatggcgatgcatggcgttgataccccaatcgattacctgaactcccacggtacttcgactccggttggcgacgtgaaagagctggcagctatccgtgaagtgttcggcgataagagcccggcgatttctgcaaccaaagccatgaccggtcactctctgggcgctgctggcgtacaggaagctatctactctctgctgatgctggaacacggctttatcgccccgagcatcaacattgaagagctggacgagcaggctgcgggtctgaacatcgtgaccgaaacgaccgatcgcgaactgaccaccgttatgtctaacagcttcggcttcggcggcaccaacgccacgctggtaatgcgcaagctgaaagattaa

SEQ ID NO: 47170 - DNA, 1086 bp, Escherichia coli
atggctggaaacacaattggacaactctttcgcgtaaccaccttcggcgaatcgcacgggctggcgctcggctgcatcgtcgatggtgttccgccaggcattccgctgacggaagcggacctgcaacatgacctcgaccgtcgtcgccctgggacatcgcgctataccacccagcgccgcgagccggatcaggtcaaaattctctccggtgtttttgaaggcgttactaccggcaccagcattggcttgttgatcgaaaacactgaccagcgctctcaggattacagtgcgattaaggacgttttccgtccaggccatgccgattacacctacgaacaaaaatacggtctgcgcgattatcgcggcggtggacgttcttccgcccgcgaaaccgccatgcgcgtggcggcaggagctattgccaaaaaatatctcgccgagaaatttggtattgaaatccgtggctgcctgacccagatgggcgacattccgctggatatcaaagactggtcgcaggtcgagcaaaatccgtttttttgcccggaccccgacaaaatcgacgcgttagacgagttgatgcgtgcgctgaaaaaagagggcgactccatcggcgctaaagtcaccgttgttgccagtggcgttcctgccggacttggcgagccggtctttgaccgcctggatgctgacatcgcccatgcgctgatgagcatcaacgcggtgaaaggcgtggaaattggcgacggctttgacgtggtggcgctgcgcggcagccagaaccgcgatgaaatcaccaaagacggtttccagagcaaccatgcgggcggcattctcggcggtatcagcagcgggcagcaaatcattgcccatatggcgctgaaaccgacctccagcattaccgtgccgggtcgtaccattaaccgctttggcgaagaagttgagatgatcaccaaaggccgtcacgatccctgtgtcgggatccgcgcagtgccgatcgcagaagcgatgctggcgatcgttttaatggatcacctgttacggcaacgggcgcaaaatgccgatgtgaagactgatattccacgctggtaa

SEQ ID NO: 47171 - DNA, 1311 bp, Escherichia coli
atgggtcaggttttaccgctggttacccgccagggcgatcgtatcgccattgttagcggtttacgtacgccttttgcccgtcaggcgacggcttttcatggcattcccgcggttgatttagggaagatggtggtaggcgaactgctggcacgcagcgagatccccgccgaagtgattgaacaactggtctttggtcaggtcgtacaaatgcctgaagcccccaacattgcgcgtgaaattgttctcggtacgggaatgaatgtacataccgatgcttacagcgtcagccgcgcttgcgctaccagtttccaggcagttgcaaacgtcgcagaaagcctgatggcgggaactattcgagcggggattgccggtggggcagattcctcttcggtattgccaattggcgtcagtaaaaaactggcgcgcgtgctggttgatgtcaacaaagctcgtaccatgagccagcgactgaaactcttctctcgcctgcgtttgcgcgacttaatgcccgtaccacctgcggtagcagaatattctaccggcttgcggatgggcgacaccgcagagcaaatggcgaaaacctacggcatcacccgagaacagcaagatgcattagcgcaccgttcgcatcagcgtgccgctcaggcatggtcagacggaaaactcaaagaagaggtgatgactgcctttatccctccttataaacaaccgcttgtcgaagacaacaatattcgcggtaattcctcgcttgccgattacgcaaagctgcgcccggcgtttgatcgcaaacacggaacggtaacggcggcaaacagtacgccgctgaccgatggcgcggcagcggtgatcctgatgactgaatcccgggcgaaagaattagggctggtgccgctggggtatctgcgcagctacgcatttactgcgattgatgtctggcaggacatgttgctcggtccagcctggtcaacaccgctggcgctggagcgtgccggtttgacgatgagcgatctgacattgatcgatatgcacgaagcctttgcagctcagacgctggcgaatattcagttgctgggtagtgaacgttttgctcgtgaagcactggggcgtgcacatgccactggcgaagtggacgatagcaaatttaacgtgcttggcggttcgattgcttacgggcatcccttcgcggcgaccggcgcgcggatgattacccagacattgcatgaacttcgccgtcgcggcggtggatttggtttagttaccgcctgtgctgccggtgggcttggcgcggcaatggttctggaggcggaataa

SEQ ID NO: 47172 - DNA, 1695 bp, Escherichia coli
atgtcagatcaacttcaaatgacagatggtatgcatatcatcgttgaagcattaaaacagaataatattgacactatttatggtgttgtaggtattcctgtgacggatatggcacgccatgcccaggcggaaggcattcgttatattggttttcgtcatgagcagtcggcaggctatgccgctgcggcaagcggttttcttacccaaaaaccggggatctgcctgacagtttctgcgccaggattcctcaatggtttgaccgcattggccaacgcaacggtaaatggttttccgatgatcatgattagcggctccagcgaccgcgcgatcgtcgacctacagcaaggtgattatgaagagctggaccaaatgaatgcggcaaaaccgtatgccaaagcagcatttcgcgttaatcagccgcaggatcttggcattgcattggcacgcgctatccgggtctctgtatcgggtcgccctggcggagtttatcttgatttgccagcaaatgtcctggccgcgacgatggaaaaagacgaagcgttaaccacgattgttaaagttgaaaatccgtcgccagcattattgccatgcccgaagtcagtcactagcgcaatttcgcttttagcaaaagctgaacggccattaattatccttggcaaaggcgcggcgtattcacaagctgatgaacagcttcgtgaatttattgaaagtgctcagattccattcctgccaatgtctatggcgaaagggatccttgaagatacgcatccactttctgcggcagctgcgcgttcgtttgccctggcaaatgctgacgttgtcatgcttgttggtgcacgactgaattggttattggcacacggtaaaaaaggatgggcggcagatacacagtttattcaactggatattgaaccgcaggaaattgacagcaaccgccccattgctgtgccagtcgttggtgatattgcatccagtatgcaaggtatgctggcagaactgaaacaaaacacatttacgactccactggtatggcgcgatattttaaatatccacaagcagcaaaatgcacaaaaaatgcatgaaaaattaagtacagatactcaaccattaaattactttaatgcattaagtgctgtgcgcgacgtattgcgcgagaaccaggatatttatttagttaatgaaggtgcaaataccctggataatgcacgaaatattattgatatgtataaaccacgtcgtcgtctggattgtggtacctggggtgtcatgggcatcggtatgggctatgccatcggtgctagcgtgacttctggttctccggttgtcgccattgaaggtgatagtgcttttggtttcagtgggatggaaattgaaacgatttgtcgatataacctgccggtgacgatcgttatttttaataatggcggcatctacagaggagacggtgttgatctcagtggcgctggtgcaccatcaccaacggatctgttgcaccatgcaaggtatgacaaattaatggatgcgtttcgtggcgttggctataacgtcaccacgacagatgaacttcgtcatgctttaaccaccggtattcagtcgcgcaaaccgaccattattaatgtggtcatcgaccctgcagcaggaactgaaagtggccatattaccaaacttaacccaaaacaagtcgctggtaattaa

SEQ ID NO: 47173 - DNA, 1239 bp, Escherichia coli
atggctgacactcgccctgaacgtcgctttacgcgcattgatcgtctcccgccctacgtttttaacatcaccgctgaactgaaaatggctgcgcgtcggcgcggcgaagatattatcgatttcagcatgggtaacccggacggtgcgactccgccgcatatcgtcgaaaaattatgtactgtggcccagcgcccggacacgcatggttactccacttcacgcggcattccgcggttacgtcgcgccatttcccgctggtatcaggatcgctacgacgttgaaatcgacccggaatcagaagccatcgtcactattggttcgaaagagggcctggcgcatctgatgctggcgacgctggatcatggtgacacggtgctggtgccgaatccaagttacccgatccatatttatggcgcggtgattgccggggcgcaggtacgctcagtgccgctggtggaaggtgtcgatttcttcaacgaactggagcgagccattcgtgaaagttatccgaaaccgaagatgatgatcctcggcttcccgtcaaacccaaccgcgcaatgcgtggaactggagttcttcgaaaaagtagtggcgctggcgaaacgctacgatgtgctggtggtccatgacctggcctatgccgatatcgtctacgatggctggaaagcgccgtcaattatgcaggtaccgggtgcacgcgatgtggcagtcgagttctttacgctgtcgaaaagctacaacatggcgggctggcgtatcggctttatggttggcaacaaaacgctggtcagcgccctggctcgtattaaaagctatcacgattacggcacctttacgccgttgcaggtggcggcgattgcggcgctggagggcgatcaacagtgcgtgcgcgacattgccgaacagtacaaacgccgccgtgatgtattggttaaagggctgcatgaagcgggctggatggttgaaatgccgaaggcttcgatgtatgtctgggcgaaaatcccggaaccatatgcggccatgggatcgctggaatttgccaagaagctccttaacgaagcgaaggtttgtgtctcgccggggattggctttggcgactatggtgatacgcatgttcgctttgcactgattgaaaaccgcgaccgtattcgtcaggccatcagagggattaaagcgatgttccgtgccgacggtttactacccgccagcagcaaacatattcacgaaaacgcggaataa

SEQ ID NO: 47174 - DNA, 2496 bp, Escherichia coli
atgttaacgattcaatttctctgtcctttgcctaacggtctacatgctcgtccggcgtgggaacttaaagaacagtgcagccagtggcaaagcgaaatcacttttattaaccatcgccagaacgcaaaggcagatgcgaaaagctcgctggcgctgattggcaccggcaccctatttaatgacagttgcagcctgaacattagcggcagcgatgaagagcaggcgcggcgcgtgctggaagagtacatccaggtgcgctttatcgacagcgacagcgttcagcctacgcaggcagaactgacggcgcatccgctgccgcgttcattaagccgccttaacccggatttactgtacggcaatgtgctggcaagcggcgtcggcgtgggtacgctgaccctgttacaaagcgacagcctcgacagttatcgggcaatccccgccagtgcgcaagattccacccggctggagcacagcctggcaacgcttgccgagcaactgaaccagcaattgcgtgagcgtgacggcgaaagcaaaactatcctcagcgcccatttgtcgctgattcaggatgatgaatttgcaggcaatatccgtcgcctgatgacagaacagcatcaggggctgggggcggcgatcatcagcaatatggagcaggtttgcgccaaactttctgcctctgccagcgattatctgcgcgaacgtgttagcgacattcgcgatatcagcgaacagttgctgcatatcacctggccggaactgaagccgcgcaacaagctggtgcttgaaaaaccgaccattctggtggctgaagatttaaccccaagccagtttttgagccttgatttgaaaaatcttgcgggcatgattctggagaaaaccgggcgcacctcgcatacactgattctggcccgtgcctcggcgatcccggtactgagtggcttgccgctggatgcgattgcccgttatgccgggcaacctgcagtgcttgacgcccagtgcggcgtgctggcgattaacccgaatgacgcggtgagcggttattatcaggtcgcgcagacgctggcggataaacgccaaaaacaacaggcgcaggctgccgcgcagctggcctattcccgtgataacaagcgtattgatattgcggcgaatatcggcaccgctctggaagcgccaggcgcgtttgccaacggcgcggaaggtgtcgggctgttccgtaccgaaatgctctatatggatcgcgacagcgcgccggacgagcaggagcaatttgaagcctaccagcaggtgctactggcggcgggcgacaagccgattatcttccgcacgatggacatcggcggcgataaaagcattccttatctgaatattccccaggaagagaacccgttcctcggctatcgcgcggtacgtatttacccggaatttgctggcctgttccgcactcaactgcgggccattttgcgcgccgccagtttcggcaacgcccagttgatgatcccgatggttcacagcctcgatcagatcttatgggtgaaaggcgagatccaaaaagcgatcgttgagcttaagcgcgatggcctgcgtcatgcagagacgattacgcttgggatcatggtggaagttccgtcggtgtgctacatcatcgaccacttctgcgatgaggtcgatttcttcagtatcggctccaacgatatgacccagtatctgtatgcggtcgatcgtaataacccgcgcgtatcgccgctatataacccgattacgccatcgttcctgcgcatgttgcagcaaatagttaccactgcgcatcagcggggcaaatgggtaggcatttgcggtgaactgggcggtgaaagccgttatctgccgctactgcttgggctgggcctggatgagctgagtatgagtagcccgcgtattccggcggtgaaaagccagcttcgtcaactggatagcgaggcgtgtcgggaactggcgcgtcaggcatgtgaatgccgcagtgcgcaggaaattgaagcgttactcaccgcctttacgccggaagaagacgttcgcccactgctggcgctggagaatatctttgttgatcaggattttagcaataaagagcaggcgatccagttcctgtgcggcaacctcggcgttaacgggcgcactgaacatccgtttgagctggaagaagatgtctggcagcgggaagagattgttaccaccggcgttggttttggcgtagcgatcccgcacaccaaatctcagtggatccgtcattccagtatcagcattgcccggctggcgaaaccgattggctggcagtcagaaatgggcgaagtcgaactggtgatcatgctgacgctgggtgctaacgaagggatgaatcatgtgaaagtcttctcgcagctggcgcgtaaactggtgaataaaaacttccgccagtcgttgtttgccgcgcaagatgcacaaagtatcctgacgctgctggaaacagaattaaccttctga

SEQ ID NO: 47175 - DNA, 1416 bp, Escherichia coli
atgaaaatcaaaactcgcttcgcgccaagcccaacaggctatctgcacgttggcggcgcgcgtactgctctttactcctggctttttgcacgtaaccacggcggtgagttcgtgctgcgtattgaagacaccgatcttgagcgttccacgccggaagctatcgaagccattatggatggcatgaactggctgagcctggagtgggatgaaggtccgtactaccagaccaaacgttttgatcgctacaacgcggtgatcgatcagatgctggaagagggcactgcttataaatgctattgctctaaagagcgcctggaagcgctgcgcgaagagcaaatggcgaaaggtgagaagccgcgttatgacggtcgctgccgccacagccatgagcatcatgctgatgatgaaccgtgtgttgtacgttttgctaacccgcaggaaggttctgttgtttttgacgatcagatccgtggtccgatcgagttcagcaaccaggaactggacgatcttattatccgccgtaccgatggttccccaacctataacttctgtgtggttgtcgatgactgggatatggaaatcacccacgttatccgtggcgaagaccatatcaacaacacgccacgccagatcaacattcttaaggccctgaaagcgccggtgccggtttacgcgcacgtttctatgatcaatggcgatgacggtaaaaaactgtccaaacgtcacggggcagtcagcgtaatgcagtatcgtgatgacggttatttgccagaagcactgctgaactatctggtgcgtctgggctggtcccacggcgatcaggaaatcttcactcgtgaagagatgatcaaatacttcactttgaatgccgtcagcaaatctgccagtgcgttcaacaccgacaagctgctgtggctgaaccatcactacattaacgcgctgccgccggagtatgttgctactcacttacagtggcacattgagcaggaaaatatcgatacccgtaacggcccgcagctggctgatctggtgaaactgctgggcgaacgctgcaagacgctgaaagagatggcacagagctgccgttatttctacgaagattttgctgagttcgatgccgacgccgcgaaaaaacatctgcgtccggtagcgcgtcagccgctggaagtggttcgtgacaaactggccgcgattactgactggaccgctgaaaacgttcatcacgctattcaggcgacggcggatgagctggaagtgggtatgggtaaagttggtatgccgctgcgtgtcgccgtaaccggtgcggggcagtctccagcactggatgttaccgttcacgcaattggtaagacccgcagtatcgagcgtatcaacaaagcgctggattttattgctgaacgcgaaaatcagcagtaa

SEQ ID NO: 47176 - DNA, 1728 bp, Escherichia coli
atgatttcaggcattttagcatccccgggtatcgctttcggtaaagctctgcttctgaaagaagacgaaattgtcattgaccggaaaaaaatttctgccgaccaggttgatcaggaagttgaacgttttctgagcggtcgtgccaaggcatcagcccagctggaaacgatcaaaacgaaagctggtgaaacgttcggtgaagaaaaagaagccatctttgaagggcatattatgctgctcgaagatgaggagctggagcaggaaatcatagccctgattaaagataagcacatgacagctgacgcagctgctcatgaagttatcgaaggtcaggcttctgccctggaagagctggatgatgaatacctgaaagaacgtgcggctgacgtacgtgatatcggtaagcgcctgctgcgcaacatcctgggcctgaagattatcgacctgagcgccattcaggatgaagtcattctggttgccgctgacctgacgccgtccgaaaccgcacagctgaacctgaagaaggtgctgggtttcatcaccgacgcgggtggccgtacttcccacacctctatcatggcgcgttctctggaactacctgctatcgtgggtaccggtagcgtcacctctcaggtgaaaaatgacgactatctgattctggatgccgtaaataatcaggtttacgtcaatccaaccaacgaagttattgataaaatgcgcgctgttcaggagcaagtggcttctgaaaaagcagagcttgctaaactgaaagatctgccagctattacgctggacggtcaccaggtagaagtatgcgctaacattggtacggttcgtgacgttgaaggtgcagagcgtaacggcgctgaaggcgttggtctgtatcgtactgagttcctgttcatggaccgcgacgcactgcccactgaagaagaacagtttgctgcttacaaagcagtggctgaagcgtgtggctcgcaagcggttatcgttcgtaccatggacatcggcggcgacaaagagctgccatacatgaacttcccgaaagaagagaacccgttcctcggctggcgcgctatccgtatcgcgatggatcgtagagagatcctgcgcgatcagctccgcgctatcctgcgtgcctcggctttcggtaaattgcgcattatgttcccgatgatcatctctgttgaagaagtgcgtgcactgcgcaaagagatcgaaatctacaaacaggaactgcgcgacgaaggtaaagcgtttgacgagtcaattgaaatcggcgtaatggtggaaacaccggctgccgcaacaattgcacgtcatttagccaaagaagttgatttctttagtatcggcaccaatgatttaacgcagtacactctggcagttgaccgtggtaatgatatgatttcacacctttaccagccaatgtcaccgtccgtgctgaacttgatcaagcaagttattgatgcttctcatgctgaaggcaaatggactggcatgtgtggtgagcttgctggcgatgaacgtgctacacttctgttgctggggatgggtctggacgaattctctatgagcgccatttctatcccgcgcattaagaagattatccgtaacacgaacttcgaagatgcgaaggtgttagcagagcaggctcttgctcaaccgacaacggacgagttaatgacgctggttaacaagttcattgaagaaaaaacaatctgctaa

SEQ ID NO: 47177 - DNA, 858 bp, Escherichia coli
ttgtttatcctgtattttcagagggaatggagtgtaacgctctgtattaacaaggagagcattaaaatgggtaaactcacgggcaagacagcactgattacgggcgcattgcagggaattggcgaaggaattgccagaacttttgcacgtcatggcgcgaacctaatcttgctggatatctcccctgagatcgaaaagctggcggacgaactgtgtggtcgtggtcatcgctgtacggcggttgtcgccgatgtgcgtgacccggcgtcggtagccgcagctatcaaacgcgcgaaggaaaaagaagggcgcattgatatcctggtgaataacgcaggcgtttgtcgtctgggcagtttcctcgatatgagcgatgacgatcgcgatttccatattgacatcaatattaaaggcgtatggaacgtcacgaaggcggtgctgccggagatgattgcccgcaaagatggtcgcattgtgatgatgtcttcagtcactggtgatatggtggccgatcctggcgaaacggcgtacgccttaacgaaagcggcgattgttggcctgacaaaatcgctggcggtggagtacgcgcagtctggtattcgcgttaacgccatttgcccgggatacgtgcgcacaccaatggcggaaagcattgcccgccagtcgaacccggaagatccagagtcggtgctgactgaaatggcgaaagcaatcccgatgcgtcgcctcgccgatccgctggaagtcggcgaactggcggccttcctcgcatcggatgaatccagctatttaaccggtacacagaatgtgattgatggcggcagcacactgccggagacggttagcgtcggtatctga

SEQ ID NO: 47178 - DNA, 900 bp, Escherichia coli
atgaaacccgacgcacaccaggttaaacagtttctgctcaaccttcaggatacgatttgtcagcagctgaccgccgtcgatggcgcagaatttgtcgaagatagttggcagcgcgaagctggcggcggcgggcgtagtcgggtgttgcgtaatggtggtgttttcgaacaggcaggcgtcaacttttcgcatgtccacggtgaggcgatgcctgcttccgccaccgctcatcgcccggaacttgccgggcgcagtttcgaggcgatgggcgtttcactggtagtgcatccgcataacccgtatgttcccaccagccacgcgaatgtgcggttttttattgccgaaaaaccgggtgccgatcccgtctggtggtttggcggtggcttcgacttaaccccattctatggttttgaagaagatgctattcactggcatcgcaccgcccgtgacctgtgcctgccatttggcgaagacgtttatccccgttacaaaaagtggtgcgacgaatacttctacctcaaacatcgcaacgaacagcgcggtattggcgggctgttctttgatgacctgaacacgccagatttcgaccgctgttttgcctttatgcaggcggtaggcaaaggctacaccgacgcttatttaccaattgtcgagcgacggaaagcgatggcctacggcgagcgcgagcgcaatttccagttatatcgtcgcggtcgttatgtcgagttcaatctggtctgggatcgcggcacgctgtttggcctgcaaactggcgggcgcaccgagtctatcctgatgtcaatgccgccactggtacgctgggaatatgattatcagccaaaagatggcagcccagaagcggcgttaagtgagtttattaaggtcagggattgggtgtaa

SEQ ID NO: 47179 - DNA, 1215 bp, Escherichia coli
gtgggcgagagaaagcggaggggctatatgcaaaatgaattgcagaccgcgctctttcaggcgttcgataccctgaatctgcaacgggtaaaaacatttagcgttccaccggtgacgctttgcggtccgggctcggtgagcagttgcggacagcaagcgcaaacgcgtgggctgaaacatctgttcgtgatggcagacagctttttgcatcaggcagggatgaccgccgggctgacgcgtagcctgaccgttaaaggtatcgccatgacgctctggccatgtccggtgggcgaaccgtgcattaccgacgtgtgtgcagccgtggcgcagttgcgtgagtcaggctgtgatggggtgatcgcgtttggcggcggctcggtgctggatgcggcgaaagccgtgacgttgctggtgacgaacccggatagcacgctggcagagatgtcagaaaccagcgttctgcaaccgcgcttgccgctgattgccattccaactaccgccggaaccggctctgaaaccaccaatgtaacggtgattatcgacgcggtgagcgggcgcaagcaggtgttagcccatgcctcgctgatgccggatgtggcgatcctcgacgccgcattgaccgaaggtgtgccgtcgcatgtcacggcgatgaccggcattgatgcgttaacccatgccattgaagcatacagcgccctgaacgctacaccgtttaccgacagtctggcgattggtgccattgcgatgattggcaaatcgctgccgaaagcggtgggctacggtcacgaccttgccgcgcgcgagagcatgttgctggcttcatgtatggcgggaatggcgttttccagtgcgggtcttgggttgtgccacgcgatggcgcatcagccgggcgcggcgctgcatattccgcacggtctcgcgaacgccatgttgctgccaacggtgatggaatttaaccggatggtttgtcgtgaacgctttagtcagattggtcgggcactgcgaactaaaaaatccgacgatcgtgacgctattaacgcggtaagtgagctgattgcggaagttgggattggtaaacgactgggcgatgttggtgcgacatctgcgcattacggcgcatgggcgcaggccgcgctggaagatatttgtctgcgcagtaacccgcgtaccgccagcctggagcagattgtcggcctgtacgcagcggcgcaataa

SEQ ID NO: 47180 - DNA, 951 bp, Escherichia coli
atgaacgagttagacggcatcaaacagttcaccactgtcgtggcagacagcggcgatattgagtccattcgccattatcatccccaggatgccaccaccaatccttcgctgttactcaaagctgccggattatcacaatatgagcatttaatagacgatgctatcgcctggggtaaaaaaaatggcaagacccaggaacaacaggtggtcgcagcgtgtgacaaactggcggtcaatttcggtgctgaaatcctcaaaatcgtacccggtcgcgtgtcaacagaagttgatgcacgcctctcttttgataaagaaaagagtattgagaaggcgcgccatctggtggacttgtatcagcaacaaggcgttgagaaatcacgcattctgatcaagctggcttcgacctgggaaggaattcgcgcggcagaagagctggaaaaagaaggtattaactgcaacctgacgctgctgttttcttttgcacaggcacgggcctgtgcggaagcaggcgtttttctgatttcgccgtttgtcgggcgtatttatgactggtatcaggcacgcaagccgatggacccgtatgtggtggaagaagatccgggcgttaaatcggtgcgcaatatctacgactactataagcaacaccactatgaaaccattgtgatgggcgcgagcttccgtcgcaccgaacaaatcctcgccttaaccggctgcgatcgactgactatcgcaccgaatttactgaaggagctgcaggaaaaagtttcgccagtggtacgtaaattaatcccaccttctcagacgttcccacgcccagctcccatgagcgaagcggagttccgttgggagcacaatcaggatgcgatggcggtagaaaaactgtctgaaggcattcgtctgttcgccgttgatcaacgcaaactggaagatcttcttgccgccaaactataa

SEQ ID NO: 47181 - DNA, 2004 bp, Escherichia coli
atgtcccgaaaagaccttgccaatgcgattcgcgcactcagtatggatgcggtacaaaaagccaactctggtcatcccggcgcgccgatgggcatggctgatattgccgaagtgctgtggaacgattttcttaaacataaccctaccgacccaacctggtatgatcgcgaccgctttattctttccaacggtcacgcgtcgatgctgctctacagtttgctacatctgaccggttacgacctgccgctggaagaactgaagaacttccgtcagttgcattcgaaaaccccaggccacccggagattggctatacgccaggcgttgaaaccaccaccggcccgcttggacaaggtttggcgaacgccgtcgggctggcgatagcagagcgtacactggcggcgcagtttaaccagccagaccatgagatcgtcgatcacttcacctatgtgtttatgggcgacggctgcctgatggaaggtatttcccacgaagtctgttcgctggcaggcacgctgggactgggcaagctgattggtttttacgatcacaacggtatttccatcgacggtgaaacagaaggctggtttaccgacgatacggcaaaacgttttgaagcctatcactggcatgtgatccatgaaatcgacggtcacgatccgcaggcggtgaaggaagcgatccttgaagcgcaaagcgtgaaagataagccgtcgctgattatctgccgtacggtgattggctttggttcgccgaataaagcaggtaaggaagaggcgcacggcgcaccactgggggaagaagaagtggcgctggcacggcaaaaactgggctggcaccatccgccatttgagatccctaaagagatttatcacgcctgggatgcccgtgaaaaaggcgaaaaagcgcagcagagctggaatgagaagtttgccgcctataaaaaggctcatccgcaactggcagaagagtttacccgacggatgagcggtggtttaccgaaggactgggagaaaacgactcagaaatatatcaatgagttacaggcaaatccggcgaaaatcgctacccgtaaggcttcgcaaaatacgcttaacgcttacgggccgatgctgcctgagttgctcggcggttcggcggatctggctcccagcaacctgaccatctggaaaggttctgtttcgctgaaggaagatccagcgggcaactacattcactacggggtgcgtgaatttggcatgaccgctatcgccaacggcatcgcgcaccacggcggctttgtgccgtataccgcgacgttcctgatgtttgttgaatacgcccgtaacgccgcgcggatggcggcactgatgaaagcgcggcagattatggtttatacccacgactcaattggcctgggcgaagatggtccgacgcaccaggctgttgagcaactggccagcctgcgcttaacgccaaatttcagcacctggcgaccgtgcgatcaggtggaagcggcggtgggctggaagctggcggttgagcgccacaacggaccgacggcactgatcctctcaaggcagaatctggcccaggtggaacgtacgccggatcaggttaaagagattgctcgtggcggttatgtgctgaaagacagcggcggtaagccagatattattctgattgccaccggttcagagatggaaattaccctgcaagcggcagagaaattagcaggagaaggtcgcaatgtacgcgtagtttccctgccctcgaccgatattttcgacgcccaggatgaggaatatcgggagtcggtgttgccttctaacgttgcggctcgcgtggcggtggaagcaggtattgccgattactggtacaagtatgttggtctgaaaggggcaattgtcgggatgacgggttacggggaatctgctccggcggataagctgttcccgttctttggctttaccgccgagaatattgtggcaaaagcgcataaggtgctgggagtgaaaggtgcctga

SEQ ID NO: 47182 - DNA, 723 bp, Escherichia coli
atgacatcagttaaggagttcgccatgaaacatgaccattttgttgttcaaagcccggataaacctgcgcaacagttgttactgcttttccacggtgtcggggataacccggtggcaatgggggaaataggcaactggtttgcaccgctgtttcctgatgcgctggtggtgagtgtcggtggcgcggagccgagcggtaatccggcggggcgtcagtggttttcggtgcagggtattacggaagataatcgccaggcgcgtgtggatgcgatcatgccgacgtttattgaaacggtgcgctactggcagaaacagagcggagtaggggctaacgccacggcgctcatcggtttctctcaaggcgcgattatggtgctggagagcattaaagccgaaccgggccttgcttcacgcgtcattgcttttaacggacgctatgcgagcctgccggaaactgcgtctacagccacgacaattcacctgattcatggcggtgaagatccggttatcgatctggcgcatgcggttgcggcgcaggaagcgttaatcagtgccggtggtgacgtgacgctggatatcgtggaggatttaggccatgcgatcgacaatcgcagtatgcaatttgccctggatcacttgcgttataccattccgaaacattatttcgacgaagcgctaagtggcggtaagcctggcgatgatgatgtgattgaaatgatgtaa

SEQ ID NO: 47183 - DNA, 879 bp, Escherichia coli
atgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggatctggctgatgggcgcattccggtaattgccgggaccggcgctaacgctactgcggaagccattagcctgacgcagcgcttcaatgacagtggtatcgtcggctgcctgacggtaaccccttactacaatcgtccgtcgcaagaaggtttgtatcagcatttcaaagccatcgctgagcatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattgggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggtcgtgagacggtcagagcggcgcttaagcatgccggtttgctgtaa

SEQ ID NO: 47184 - DNA, 1467 bp, Escherichia coli
atgctacgtatcgctaaagaagctctgacgtttgacgacgttctcctcgttcctgctcactctaccgttctgccgaatactgctgacctcagcacccagctgacgaaaactattcgtctgaatatccctatgctttccgcagcaatggataccgtaacggaagcgcgcctggctattgctctggctcaggaaggcggtatcggctttatccacaaaaacatgtccattgaacgccaggcagaagaagttcgccgtgtgaaaaaacacgaatctggtgtggtgactgatccgcagactgttctgccaaccacgacgctgcgcgaagtgaaagaactgaccgagcgtaacggttttgcgggctatccggtcgttaccgaagaaaacgaactggtgggtattatcaccggtcgtgacgtgcgttttgttaccgacctgaaccagccggttagcgtttacatgacgccgaaagagcgtctggtcaccgtgcgtgaaggtgaagcccgtgaagtggtgctggcaaaaatgcacgaaaaacgcgttgaaaaagcgctggtggttgatgacgaattccacctgatcggcatgatcaccgtgaaagacttccagaaagcggaacgtaaaccgaacgcctgtaaagacgagcaaggccgtctgcgtgttggtgcagcggttggcgcaggtgcgggtaacgaagagcgtgttgacgcgctggttgccgcaggcgttgacgttctgctgatcgactcctcccacggtcactcagaaggtgtactgcaacgtatccgtgaaacccgtgctaaatatccggatctgcaaattatcggcggcaacgtggcaacagctgcaggtgcacgcgctctggcagaagctggttgcagtgcggttaaagtcggcattggccctggctctatctgtacaactcgtatcgtgactggcgtcggtgttccgcagattaccgctgttgctgacgcagtagaagccctggaaggcaccggtattccggttatcgctgatggcggtattcgcttctccggcgacatcgccaaagctatcgccgctggcgcaagcgcggtgatggtaggttccatgctggcgggtactgaagaatctccgggtgaaatcgaactctaccagggccgttcttacaaatcttaccgtggtatgggttccctgggcgcgatgtccaaaggttcctctgaccgttatttccagagcgataacgctgccgacaaactggtgccggaaggtatcgaaggtcgcgtagcctataaaggtcgcctgaaagagatcattcaccagcagatgggcggcctgcgctcctgtatgggtctgaccggctgtggtactatcgacgaactgcgtactaaagcggagtttgtacgtatcagcggtgcgggcattcaggaaagccacgttcacgacgtgaccattactaaagagtccccgaactaccgtctgggctcctga

SEQ ID NO: 47185 - DNA, 432 bp, Escherichia coli
atggctattgaacgtactttttccatcatcaaaccgaacgcggtagcaaaaaacgtcattggtaatatctttgcgcgctttgaagctgcagggttcaaaattgttggcaccaaaatgctgcacctgaccgttgaacaggcacgtggcttttatgctgaacacgatggaaaaccgttctttgatggtctggttgaattcatgacctctggcccgatcgtggtttccgtgctggaaggtgaaaacgccgttcagcgtcaccgcgatctgctgggcgcgaccaatccggcaaacgcactggctggtactctgcgcgctgattacgctgacagcctgaccgaaaacggtacccacggttctgattccgtcgaatctgccgctcgcgaaatcgcttatttctttggcgaaggcgaagtgtgcccgcgcacccgttaa

SEQ ID NO: 47186 - DNA, 1005 bp, Escherichia coli
atgcgtgagaatttacgttatgtaattcagtatcacgcccatacaatccgaattttagtgagaattgtggctcagacagccaaatcagcctcttttgcttgtcgcttttcactaaacatccgacaatttagcctaaccccggcaaaaatggagatgcctatgtccacgacatggtttgtaggagccgactggctcgccgaacatattgatgacccggaaattcagattatcgatgcccgcatggcgtcgcctggacaggaggatcgtaacgttgctcaggagtatctgaatggacatattcccggcgcagtgttttttgatatcgaagcgctttctgatcacacttccccgcttccgcacatgctgccgcgcccggaaacgttcgccgtggcgatgcgtgaattaggcgttaaccaggataagcacctgattgtctatgacgaaggtaatcttttctcagccccacgagcatggtggatgctgcgcacctttggtgtagagaaagtgtcgattctggggggtggacttgcaggctggcagcgcgatgatctgctgttagaagaaggtgcagtagagctgccggaaggagagtttaacgccgcgtttaatcctgaagccgtggtgaaagtaaccgatgtattattggcaagccatgaaaatacggcgcaaattattgatgcccgcccggctgcacgttttaacgcagaagttgatgaacctcgcccaggtttacgtcgcggacatattcccggagcactgaatgttccgtggacggaactggtgcgcgaaggcgaactaaaaacgaccgatgaactggatgcgatattttttggtcgcggcgtcagctacgacaaaccaattatcgtcagctgcggctctggtgtaacggcagccgtggttttgttagcactcgcgacgctggatgtgccaaacgtgaaactgtacgacggcgcatggagtgaatggggcgcgcgggcagatttaccggttgagccagtgaaataa

SEQ ID NO: 47187 - DNA, 1851 bp, Escherichia coli
atggccttattacaaattagtgaacctggtttgagtgctgcgccgcatcagcgtcgtctggcggccggtattgacctgggcacaaccaactcgctggtggcgacagtgcgcagcggtcaggccgaaacgttagccgatcatgaaggccgtcacctgctgccatctgttgttcactatcaacagcaagggcattcggtgggttatgacgcgcgtactaatgcagcgctcgataccgccaacacaattagttctgttaaacgcctgatgggacgctcgctggctgatatccagcaacgctatccgcatctgccttatcaattccaggccagcgaaaacggcctgccgatgattgaaacggcggcggggctgctgaacccggtgcgcgtttctgcggacatcctcaaagcactggcggcgcgggcaactgaagccctggcaggcgagctggatggtgtagttatcaccgttccggcgtactttgacgatgcccagcgtcagggcaccaaagacgcggcgcgtctggcgggccttcacgtcctgcgcttacttaacgaaccgaccgctgcggctatcgcctacgggctggattccggtcaggaaggcgtgatcgccgtttatgacctcggtggcgggacgtttgatatttccattctgcgcttaagtcgcggcgtgtttgaagtgctggcaaccggcggtgattccgcgctcggcggcgatgatttcgaccatctgctggcggattacattcgcgagcaggcgggcattcctgatcgtagcgataaccgcgttcagcgtgaactgctggatgccgccattgcagccaaaatcgcgctgagcgatgcggactccgtgaccgttaacgttgcgggctggcagggcgaaatcagccgtgaacaattcaatgaactgatcgcgccactggtaaaacgaaccttactggcttgtcgtcgcgcgctgaaagacgcgggtgtagaagctgatgaagtgctggaagtggtgatggtgggcggttctactcgcgtgccgctggtgcgtgaacgggtaggcgaatttttcggtcgtccaccgctgacttccatcgacccggataaagtcgtcgctattggcgcggcgattcaggcggatattctggtgggtaacaagccagacagcgaaatgctgttgcttgatgtgatcccactgtcgctgggcctcgaaacgatgggcggcctggtggagaaagtgattccgcgtaataccactattccggtggcccgcgctcaggatttcaccacctttaaagatggtcagacggcgatgtctatccatgtaatgcagggtgagcgcgaactggtgcaggactgccgctcactggcgcgttttgcgctgcgtggtattccggcgctaccggctggcggtgcgcatattcgcgtgacgttccaggtcgatgccgacggtcttttgagcgtgacggcgatggagaaatccaccggcgttgaggcgtctattcaggtcaaaccgtcttacggtctgaccgatagcgaaatcgcttcgatgatcaaagactcaatgagctatgccgagcaggacgtaaaagcccgaatgctggcagaacaaaaagtagaagcggcgcgtgtgctggaaagtctgcacggcgcgctggctgctgatgccgcgctgttaagcgccgcagaacgtcaggtcattgacgatgctgccgctcacctgagtgaagtggcgcagggcgatgatgttgacgccatcgaacaagcgattaaaaacgtagacaaacaaacccaggatttcgccgctcgccgcatggaccagtcggttcgtcgtgcgctgaaaggccattccgtggacgaggtttaa

SEQ ID NO: 47188 - DNA, 813 bp, Escherichia coli
atgagcgatctgcataacgagtccatttttattaccggcggcggatcgggattagggctggcgctggtcgagcgatttatcgaagaaggcgcgcaggttgccacgctggaactgtcggcggcaaaagtcgccagtctgcgtcagcgatttggcgaacatattctggcggtggaaggtaacgtgacctgttatgccgattatcaacgcgcggtcgatcagatcctgactcgttccggcaagctggattgttttatcggcaatgcaggcatctgggatcacaatgcctcactggttaatactcccgcagagacgctcgaaaccggcttccacgagctgtttaacgtcaatgttctcggttacctgctgggcgcaaaagcctgcgctccggcgttaatcgccagtgaaggcagcatgattttcacactgtcaaatgccgcctggtatcctggcggcggtggcccgctgtacaccgccagtaaacatgccgcaaccggacttattcgccaactggcttatgaactggcaccgaaagtgcgggtgaatggcgtcggcccgtgtggtatggccagcgacctgcgcggcccacaggcgctcgggcaaagtgaaacctcgataatgcagtctctgacgccggagaaaattgccgccattttaccgctgcaatttttcccgcaaccggcggattttacggggccgtatgtgatgttgacatcgcggcgcaataatcgcgcattaagcggtgtgatgatcaacgctgatgcgggtttagcgattcgcggcattcgccacgtagcggctgggctggatctttaa

SEQ ID NO: 47189 - DNA, 1095 bp, Escherichia coli
atgaaaattaatcgtattgttaatgagggatttatgaaaacgatgctggcagcttatttaccaggaaattcgaccgtcgatctgcgggaagttgcggtgccgacgccggggattaaccaggtactgatcaaaatgaaatcctccgggatttgcggaagcgatgtccactatatctatcatcaacaccgtgccacagcggcggcacccgataaaccgttataccagggctttatcaacggtcatgaaccgtgcgggcagattgtggcgatggggcaaggctgccgccattttaaagagggcgaccgcgtgctggtgtatcacatttctggctgtggtttttgcccgaactgccgtcgcggttttcctatttcttgtactggcgaaggaaaagcggcttacggctggcagcgtgacggcggtcatgccgaatacttgctggcggaagaaaaagatctgatcctcctgccggatgcgctgagctacgaagatggtgcgtttatcagttgcggcgttggtacagcgtatgaaggaattttgcgcggcgaagtttccggcagtgataacgtgctggtggtcggtctggggccagtcggcatgatggcgatgatgctggcgaaaggtcgcggtgcaaaacggatcatcggcgttgatatgctgccggaacgtctggcgatggcaaaacagttaggggtgatggatcacggctatttagcaaccaccgaaggtctgccgcagattatcgccgaactcacccacggtggcgcggatgttgcgctcgattgttccggtaatgccgcaggtcgcttgctggcactgcaatccaccgctgactggggacgggtggtttacattggtgaaaccggaaaagtggaattcgaggtcagcgccgatctgatgcaccatcaacggcggattatcggctcctgggtgaccagtctgttccatatggaaaaatgcgcccatgatctgacggactggaagctgtggccgcgtaacgccattacccatcgcttctcgctggaacaggcaggtgatgcctatgcgctgatggcgagcggcaaatgcgggaaagttgtgattaacttcccggattaa

SEQ ID NO: 47190 - DNA, 1512 bp, Escherichia coli
atgttcacggcaacagaggcagtcccggtagcaaaagtggtggcaggaaataagcgttatcccggcgtcgttgcgctggataacgttaacttcacgctcaataaaggcgaagttcgtgcgctgttaggtaaaaacggcgcgggcaaatcgactctcattcgaatgcttaccggcagcgaacgcccggatagcggtgatatctggattggcgagacgcgactggaaggtgacgaagctacgctgactcgccgtgccgctgaactgggggtgcgcgcggtttatcaggagttaagtctggtggaagggctgacagtggcggaaaacctctgcctcggtcagtggccccgccgcaacggcatgattgattacctgcaaatggcgcaggatgcccaacgttgcttacaggcgctgggcgttgacgttagtcctgaacaacttgtttcaacgctaagcccggcgcaaaagcagctggtggaaattgcgcgggtgatgaagggcgagccgcgcgtggtcattcttgatgaacctaccagttcgcttgcgagtgcggaagttgaactggtgatcagcgcggtgaaaaagatgtcggcactgggcgtggcggtgatttatgtcagccaccggatggaagaaattcgccgcattgcctcctgtgccaccgttatgcgcgatggtcaggtggcgggcgatgtgatgctcgaaaacacctccacgcatcatattgtgtcgctgatgctcgggcgcgatcacgttgatattgcgccggtagcccctcaggaaattgtggatcaggccgtgctggaagtccgtgcgttacgccataagcccaagctggaggatatcagttttacgctacgtcgtggcgaagtgctcggcattgctggtctgctgggggcagggcgcagtgaattgctgaaggcgattgttgggctggaggagtatgaacagggcgaaattgttatcaacggcgagaaaatcacgcgccccgattacggcgacatgctgaaacgcggcattggctatacgccagaaaaccgcaaagaagcggggatcattccctggttgggcgttgacgaaaatacagtgctgaccaatcggcaaaaaatcagcgccaacggtgtgctgcaatggtccaccatccgccgcctgaccgaagaggtgatgcagcggatgacggtcaaggccgccagtagcgaaacacccatcggcacgctttctggtggcaatcagcaaaaagtggtgatcggtcgttgggtctatgctgccagccagattttgttgctcgacgagccaacgcgcggcgtcgatatcgaagccaaacagcagatttaccgtattgtccgtgagctggctgccgaaggaaaaagcgtggtgtttatctccagtgaagtggaggagttgccgctggtgtgtgaccgcatcctgttattacagcacggcacgttctcgcaggagtttcacgctccggtcaatgtggatgagctgatgtccgccattctgtctgtgcactga

SEQ ID NO: 47191 - DNA, 975 bp, Escherichia coli
atggcgaatatgtttgccctgattctggtgattgccacactggtgacgggcattttatggtgcgtggataaattctttttcgcacctaaacggcgggaacgtcaggcagcggcgcaggcggctgccggggactcactggataaagcaacgttgaaaaaggttgcgccgaagcctggctggctggaaaccggtgcttctgtttttccggtactggctatcgtattgattgtgcgttcgtttatttatgaaccgttccagatcccgtcaggttcgatgatgccgactctgttaattggtgattttattctggtagagaagtttgcttatggcattaaagatcctatctaccagaaaacgctgatcgaaaccggtcatccgaaacgcggcgatatcgtggtctttaaatatccggaagatccaaagcttgattacatcaagcgcgcggtgggtttaccgggcgataaagtcacttacgatccggtctcaaaagagctgacgattcaaccgggatgcagttccggccaggcgtgtgaaaacgcgctgccggtcacctactcaaacgtggaaccgagcgatttcgttcagaccttctcacgccgtaatggtggggaagcgaccagcggattctttgaagtgccgaaaaacgaaaccaaagaaaatggaattcgtctttccgagcgtaaagagacactgggtgatgtgacgcaccgcattctgacagtgccgattgcgcaggatcaggtggggatgtattaccagcagccagggcaacaactggcaacctggattgttcctccgggacaatacttcatgatgggcgacaaccgcgacaacagcgcggacagccgttactggggctttgtgccggaagcgaatctggtcggtcgggcaacggctatctggatgagcttcgataagcaagaaggcgaatggccgactggtctgcgcttaagtcgcattggcggcatccattaa

SEQ ID NO: 47192 - DNA, 1623 bp, Escherichia coli
atgaatactctccctgaacattcatgtgacgtgttgattatcggtagcggcgcagccggactttcactggcgctacgcctggctgaccagcatcaggtcatcgttctaagtaaaggcccggtaacggaaggttcaacattttatgcccagggcggtattgccgccgtgtttgatgaaactgacagcattgactcgcatgtggaagacacattgattgccggggctggtatttgcgatcgccatgcagttgaatttgtcgccagcaatgcacgatcctgtgtgcaatggctaatcgaccagggggtgttgtttgatacccacattcaaccgaatggcgaagaaagttaccatctgacccgtgaaggtggacatagtcaccgtcgtattcttcatgccgccgacgccaccggtagagaagtagaaaccacgctggtgagcaaggcgctgaaccatccgaatattcgcgtgctggagcgcagcaacgcggttgatctgattgtttctgacaaaattggcctgccgggcacgcgacgggttgttggcgcgtgggtatggaaccgtaataaagaaacggtggaaacctgccacgcaaaagcggtggtgctggcaaccggcggtgcgtcgaaggtttatcagtacaccaccaatccggatatttcttctggcgatggcattgctatggcgtggcgcgcaggctgccgggttgccaatctcgaatttaatcagttccaccctaccgcgctatatcacccacaggcacgcaatttcctgttaacagaagcactgcgcggcgaaggcgcttatctcaagcgcccggatggtacgcgttttatgcccgattttgatgagcgcggcgaactggccccgcgcgatattgtcgcccgcgccattgaccatgaaatgaaacgcctcggcgcagattgtatgttccttgatatcagccataagcccgccgattttattcgccagcatttcccgatgatttatgaaaagctgctcgggctggggattgatctcacacaagaaccggtaccgattgtgcctgctgcacattatacctgcggtggtgtaatggttgatgatcatgggcgtacggacgtcgagggcttgtatgccattggcgaggtgagttataccggcttacacggcgctaaccgcatggcctcgaattcattgctggagtgtctggtctatggctggtcggcggcggaagatatcaccagacgtatgccttatgcccacgacatcagtacgttaccgccgtgggatgaaagccgcgttgagaaccctgacgaacgggtagtaattcagcataactggcacgagctacgtctgtttatgtgggattacgttggcattgtgcgcacaacgaagcgcctggaacgcgccctgcggcggataaccatgctccaacaagaaatagacgaatattacgcccatttccgcgtctcaaataatttgctggagctgcgtaatctggtacaggttgccgagttgattgttcgctgtgcaatgatgcgtaaagagagtcgggggttgcatttcacgctggattatccggaactgctcacccattccggtccgtcgatcctttcccccggcaatcattacataaacagataa

SEQ ID NO: 47193 - DNA, 1335 bp, Escherichia coli
atgactgtaacgactttttccgaacttgaactcgacgaaagcctgctggaagccctccaggataaaggtttcactcgcccgaccgccattcaggctgccgccattccgcctgcgctcgatggccgtgatgtactcggttctgcgccgacaggcaccggtaaaacggcggcgtatctgctgccagcgttgcagcacctgctcgatttcccgcgtaagaaatccggtccgccgcgtattttgatcctcaccccaactcgcgagctggcgatgcaggtgtccgatcatgcccgcgaactggcgaaacatacgcatctggatatcgccaccatcaccggcggcgtagcctatatgaaccacgcggaagtgttcagcgaaaatcaggacatcgtggtcgccacgaccggacgtctgctgcaatacataaaagaagagaacttcgattgccgcgcggttgaaacgctgatcctcgacgaagcagaccgtatgctggatatgggcttcgctcaggatatcgaacatattgctggcgaaacgcgctggcgtaaacagaccctgctcttttcggcaacgctggaaggcgatgcgattcaggactttgccgagcgtctgctggaagatccggtggaagtttctgccaatccctccacccgtgagcgcaaaaaaattcatcagtggtattaccgcgccgatgatcttgagcataaaaccgcgttgctggtgcatctgttaaaacagccggaagcgacccgctcaattgtgtttgtgcgtaagcgtgagcgtgtgcatgagctggcaaactggctgcgcgaagcgggcatcaacaactgctatctcgaaggtgagatggtacagggcaagcgtaacgaagcgatcaagcgtttgaccgaaggtcgcgtaaacgtactggtcgcaaccgatgttgccgcgcgcggtatcgacattcctgacgtcagccacgtctttaacttcgatatgccgcgcagtggcgatacttatttgcaccgtatcggacgtaccgcgcgcgccggtcgtaaaggcaccgcaatttcgctggtggaagcccatgaccatctgctgctgggtaaagtaggccgctatattgaagagccaattaaagctcgcgttattgatgagttacgcccgaaaacgcgtgcgccaagcgaaaagcagaccggcaagccatcgaagaaagtactggctaaacgtgctgagaagaaaaaagctaaagagaaagagaagccgcgggtgaaaaaacgccatcgcgacaccaaaaatattggtaagcgccgtaaaccaagcggaacgggcgtgccaccgcaaacgacagaagagtaa

SEQ ID NO: 47194 - DNA, 690 bp, Escherichia coli
atggctaacgaattaacctggcatgacgtgctggctgaagagaagcagcaaccctattttcttaatacccttcagaccgtcgccagcgagcggcagtccggcgtcactatctacccaccacaaaaagatgtctttaacgcgttccgctttacagagttgggtgacgttaaagtggtgattctcggccaggatccttatcacggaccgggacaggcgcatggtctggcattttccgttcgtcccggcattgccattcctccgtcattattgaatatgtataaagagctggaaaatactattccgggcttcacccgccctaatcatggttatcttgaaagctgggcgcgtcagggcgttctgctactcaatactgtgttgacggtacgcgcaggtcaggcgcattcccacgccagcctcggctgggaaaccttcaccgataaagtgatcagcctgattaaccagcatcgcgaaggcgtggtgtttttgttgtggggatcgcatgcgcaaaagaaaggggcgattatagataagcaacgccatcatgtactgaaagcaccgcatccgtcgccgctttcggcgcatcgtggattctttggctgcaaccattttgtgctggcaaatcagtggctggaacaacgtggcgagacgccgattgactggatgccagtattaccggcagagagtgagtaa

SEQ ID NO: 47195 - DNA, 2574 bp, Escherichia coli
atgcgtctggatcgtcttactaataaattccagcttgctcttgccgatgcccaatcacttgcactcgggcacgacaaccaatttatcgaaccacttcatttaatgagcgccctgctgaatcaggaagggggttcggttagtcctttattaacatccgctggcataaatgctggccagttgcgcacagatatcaatcaggcattaaatcgtttaccgcaggttgaaggtactggtggtgatgtccagccatcacaggatctggtgcgcgttcttaatctttgcgacaagctggcgcaaaaacgtggtgataactttatctcgtcagaactgttcgttctggcggcacttgagtctcgcggcacgctggccgacatcctgaaagcagcaggggcgaccaccgccaacattactcaagcgattgaacaaatgcgtggaggtgaaagcgtgaacgatcaaggtgctgaagaccaacgtcaggctttgaaaaaatataccatcgaccttaccgaacgagccgaacagggcaaactcgatccggtgattggtcgtgatgaagaaattcgccgtaccattcaggtgctgcaacgtcgtactaaaaataacccggtactgattggtgaacccggcgtcggtaaaactgccatcgttgaaggtctggcgcagcgtattatcaacggcgaagtgccggaagggttgaaaggccgccgggtactggcgctggatatgggcgcgctggtggctggggcgaaatatcgcggtgagtttgaagaacgtttaaaaggcgtgcttaacgatcttgccaaacaggaaggcaacgtcatcctatttatcgacgaattacataccatggtcggcgcgggtaaagccgatggcgcaatggacgccggaaacatgctgaaaccggcgctggcgcgtggtgaattgcactgcgtaggtgccacgacgcttgacgaatatcgccagtacattgaaaaagatgctgcgctggaacgtcgtttccagaaagtgtttgttgccgagccttctgttgaagataccattgcgattctgcgtggcctgaaagaacgttacgaattgcaccaccatgtgcaaattactgacccggcaattgttgcagcggcgacgttgtctcatcgctacattgctgaccgtcagctgccggataaagccatcgacctgatcgatgaagcagcatccagcattcgtatgcagattgactcaaaaccagaagaactcgaccgactcgatcgtcgtatcatccagctcaaactggaacaacaggcgttaatgaaagagtctgatgaagccagtaaaaaacgtctggatatgctcaacgaagaactgagcgacaaagaacgtcagtactccgagttagaagaagagtggaaagcagagaaggcatcgctttctggtacgcagaccattaaagcggaactggaacaggcgaaaatcgctattgaacaggctcgccgtgtgggggacctggcgcggatgtctgaactgcaatacggcaaaatcccggaactggaaaagcaactggaagccgcaacgcagctcgaaggcaaaactatgcgtctgttgcgtaataaagtgaccgacgccgaaattgctgaagtgctggcgcgttggacggggattccggtttctcgcatgatggaaagcgagcgcgaaaaactgctgcgtatggagcaagaactgcaccatcgcgtaattggtcagaacgaagcggttgatgcggtatctaacgctattcgtcgtagccgtgcggggctggcggatccaaatcgcccgattggttcattcctgttcctcggcccaactggtgtggggaaaacagagctttgtaaggcgctggcgaactttatgtttgatagcgacgaggcgatggtccgtatcgatatgtccgagtttatggagaaacactcggtgtctcgtttggttggtgcgcctccgggatatgtcggttatgaagaaggtggctacctgaccgaagcggtgcgtcgtcgtccgtattccgtcatcctgctggatgaagtggaaaaagcgcatccggatgtcttcaacattctgttgcaggtactggatgatgggcgtctgactgacgggcaagggagaacggtcgacttccgtaatacggtcgtcattatgacctctaacctcggttccgatctgattcaggaacgcttcggtgaactggattatgcgcacatgaaagagctggtgctcggtgtggtaagccataacttccgtccggaattcattaaccgtatcgatgaagtggtggtcttccatccgctgggtgaacagcacattgcctcgattgcgcagattcagttgaaacgtctgtacaaacgtctggaagaacgtggttatgaaatccacatttctgacgaggcgctgaaactgctgagcgagaacggttacgatccggtctatggtgcacgtcctctgaaacgtgcaattcagcagcagatcgaaaacccgctggcacagcaaatactgtctggtgaattggttccgggtaaagtgattcgcctggaagttaatgaagaccggattgtcgccgtccagtaa

SEQ ID NO: 47196 - DNA, 1071 bp, Escherichia coli
atgcaaaaagacgcgctgaataacgtacatattaccgacgaacaggttttaatgactccggaacaactgaaggccgcttttccattgagcctgcaacaagaagcccagattgctgactcgcgtaaaagcatttcagatattatcgccgggcgcgatcctcgtctgctggtagtatgtggtccttgttccattcatgatccggaaactgctctggaatatgctcgtcgatttaaagcccttgccgcagaggtcagcgatagcctctatctggtaatgcgcgtctattttgaaaaaccccgtaccactgtcggctggaaagggttaattaacgatccccatatggatggctcttttgatgtagaagccgggctgcagatcgcgcgtaaattgctgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggttttaaaaacggcaccgacggcagtctggcaacagcaattaacgctatgcgcgccgccgcccagccgcaccgttttgttggcattaaccaggcagggcaggttgcgttgctacaaactcaggggaatccggacggccatgtgatcctgcgcggtggtaaagcgccgaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggcaatcgctcaattattggtctgatgatcgaaagtaatatccacgagggcaatcagtcttccgagcaaccgcgcagtgaaatgaaatacggtgtatccgtaaccgatgcctgcattagctgggaaatgaccgatgccttgctgcgtgaaattcatcaggatctgaacgggcagctgacggctcgcgtggcttaa

SEQ ID NO: 47197 - DNA, 468 bp, Escherichia coli
atgaaaatacgttcactaagccggtttgtactggcaagtacaatgttcgccagctttacagcctctgcggtccccggactctggcaacaggggtacggtcagggcaatgcggaatacagtgtgacggatgccagcggaaagatgtttaccatcaactgcacgggaaatccggaccagaacggtatttaccagcactcggtttttctgatcctcgccggggataaaacggtcagctcgcatgatgacagtaccggcatcacagtggtgatggaccataagcaatatgccattccctcaacccttggctggcgtaacggagataatgcctggttcagcttcatcatggatatccgtaaggcccggcagttcgacgtctacgtcaatgaccagaaagttggatcgtttaaccctgatgttcggaatgcacaaaaggtcctgccaacattagcggactgcactaacgactga

SEQ ID NO: 47198 - DNA, 1449 bp, Escherichia coli
atgaaacttaacgacagtaacttattccgccagcaggcgttgattaacggggaatggctggacgccaacaatggtgaagccatcgacgtcaccaatccggcgaacggcgacaagctgggtagcgtgccgaaaatgggcgcggatgaaacccgcgccgctatcgacgccgccaaccgcgccctgcccgcctggcgcgcgctcaccgccaaagaacgcgccaccattctgcgcaactggttcaatttgatgatggagcatcaggacgatttagcgcgcctgatgaccctcgaacagggtaaaccactggccgaagcgaaaggcgaaatcagctacgccgcctcctttattgagtggtttgccgaagaaggcaaacgcatttatggcgacaccattcctggtcatcaggccgataaacgcctgattgttatcaagcagccgattggcgtcaccgcggctatcacgccgtggaacttcccggcggcgatgattacccgcaaagccggtccggcgctggcagcaggctgcaccatggtgctgaagcccgccagtcagacgccgttctctgcgctggcgctggcggagctggcgatccgcgcgggcgttccggctggggtatttaacgtggtcaccggttcggcgggcgcggtcggtaacgaactgaccagtaacccgctggtgcgcaaactgtcgtttaccggttcgaccgaaattggccgccagttaatggaacagtgcgcgaaagacatcaagaaagtgtcgctggagctgggcggtaacgcgccgtttatcgtctttgacgatgccgacctcgacaaagccgtggaaggcgcgctggcctcgaaattccgcaacgccgggcaaacctgcgtctgcgccaaccgcctgtatgtgcaggacggcgtgtatgaccgttttgccgaaaaattgcagcaggcagtgagcaaactgcacatcggcgacgggctggataacggcgtcaccatcgggccgctgatcgatgaaaaagcggtagcaaaagtggaagagcatattgccgatgcgctggagaaaggcgcgcgcgtggtttgcggcggtaaagcgcacgaacgcggcggcaacttcttccagccgaccattctggtggacgttccggccaacgccaaagtgtcgaaagaagagacgttcggccccctcgccccgctgttccgctttaaagatgaagctgatgtgattgcgcaagccaatgacaccgagtttggccttgccgcctatttctacgcccgtgatttaagccgcgtcttccgcgtgggcgaagcgctggagtacggcatcgtcggcatcaataccggcattatttccaatgaagtggccccgttcggcggcatcaaagcctcgggtctgggtcgtgaaggttcgaagtatggcatcgaagattacttagaaatcaaatatatgtgcatcggtctttaa

SEQ ID NO: 47199 - DNA, 1281 bp, Escherichia coli
atgaacagcaataaagagttaatgcagcgccgcagtcaggcgattccccgtggcgttgggcaaattcacccgattttcgctgaccgcgcggaaaactgccgggtgtgggacgttgaaggccgtgagtatcttgatttcgcgggcgggattgcggtgctcaataccgggcacctgcatccgaaggtggtggccgcggtggaagcgcagttgaaaaaactgtcgcacacctgcttccaggtgctggcttacgagccgtatctggagctgtgcgagattatgaatcagaaggtgccgggcgatttcgccaagaaaacgctgctggttacgaccggttccgaagcggtggaaaacgcggtaaaaatcgcccgcgccgccaccaaacgtagcggcaccatcgcttttagcggcgcgtatcacgggcgcacgcattacacgctggcgctgaccggcaaggtgaatccgtactctgcgggcatggggctgatgccgggtcatgtttatcgcgcgctttatccttgcccgctgcacggcataagcgaggatgacgctatcgccagcatccaccggatcttcaaaaatgatgccgcgccggaagatatcgccgccatcgtgattgagccggttcagggcgaaggcggtttctacgcctcgtcgccagcctttatgcagcgtttacgcgctctgtgtgacgagcacgggatcatgctgattgccgatgaagtgcagagcggcgcggggcgtaccggcacgctgtttgcgatggagcagatgggcgttgcgccggatcttaccacctttgcgaaatcgatcgcgggcggcttcccgctggcgggcgtcaccgggcgcgcggaagtaatggatgccgtcgctccaggcggtctgggcggcacctatgcgggtaacccgattgcctgcgtggctgcgctggaagtgttgaaggtgtttgagcaggaaaatctgctgcaaaaagccaacgatctggggcagaagttgaaagacggattgctggcgatagccgaaaaacacccggagatcggcgacgtacgcgggctgggggcgatgatcgccattgagctgtttgaagacggcgatcacaacaagccggacgccaaactcaccgccgagatcgtggctcgcgcccgcgataaaggcctgattcttctctcctgcggcccgtattacaacgtgctgcgcatccttgtaccgctcaccattgaagacgctcagatccgtcagggtctggagatcatcagccagtgttttgatgaggcgaagcagtag

SEQ ID NO: 47200 - DNA, 1401 bp, Escherichia coli
atggggcaatcatcgcaaccacatgagttaggcggcgggctgaagtcacgccacgtcaccatgttgtctattgccggtgttatcggcgcaagtctgtttgtcggttccagcgtcgccatcgccgaagcgggcccggcggtattactggcctatctgttcgccgggctactggtggttatgattatgcggatgttggcggaaatggcggttgccacgcccgataccggttcgttttccacctatgccgataaagccattggtcgctgggcgggctataccatcggctggttgtactggtggttttgggtactggttatcccgctggaagccaacatcgccgccatgatcctgcactcatgggttccaggcattcccatctggttattttccctcgtcattaccctcgccttaactggcagtaacttattaagcgttaaaaactacggcgaatttgagttctggctggcgctgtgcaaagtcatcgctatcctggcctttattttccttggtgcagtcgcaattagcggtttttacccgtatgccgaagtgagcgggatctcaagattgtgggatagcggcggctttatgcccaacggtttcggtgcggtattaagcgcgatgttgatcaccatgttctcgtttatgggcgcagaaattgtcaccattgccgccgcggaatccgacacgccggaaaaacatattgtccgcgccaccaactcggttatctggcgtatttctatcttctatttatgttctatttttgtcgtcgtggcattaattccgtggaatatgcccggactaaaagccgtcggttcttatcgctcggtactggaattgctcaatattccccatgcgaaattaatcatggactgcgtgatattactttccgtaaccagttgcctgaactcggcgctgtataccgcgtcaaggatgctctactccttaagtcgtcgcggtgatgctcccgcggtaatgggtaaaatcaaccgcagtaaaaccccgtacgtggcggtgttactctccaccggcgcggcattcttaacggtggtggtgaactattacgcgcctgcgaaggtatttaaatttctgatcgacagctccggcgctatcgccctgctggtttatttagtcatcgccgtttcacagttgcggatgcgcaaaattctgcgagcagaaggaagcgaaattcgcttgcgaatgtggctttatccgtggctcacctggctagtcatcggctttattacctttgtgttggtagtgatgctattccgtccggcgcaacagttagaagtgatctccaccggcttattagcgatagggattatctgtaccgtgccaattatggctcgctggaaaaagctggtattgtggcaaaaaacacccgttcataatacgcgctga

SEQ ID NO: 47201 - DNA, 2145 bp, Escherichia coli
ttggcaacgacaaccgcagaatgcctgacgcaggaaacgatggattaccacgcgctgaatgcgatgcttaacctctacgatagcgcaggtcgcattcagttcgataaagaccgccaggccgttgacgcctttattgcgacgcatgtgcgtccgaacagtgtgaccttcagtagccagcagcagcgcctgaactggctggtcaacgaaggttactatgatgaaagcgttcttaatcgctactctcgcgactttgtcattacgctgtttacccacgcacacaccagcggttttcgtttccagacattcctcggggcatggaagttttacaccagctatacgttgaagacattcgacggtaaacgttatctggaagattttgccgatcgagtaacgatggtggcgctgacgctggcacaaggcgatgagacgctggcgttgcaactgaccgatgaaatgctgtcaggacgctttcagccagccacgccaacattcctcaactgcggtaagcagcagcgcggcgaactggtttcctgttttttgctgcgtattgaagacaatatggagtcgattggtcgggcggtaaattccgcactgcagctgtcgaaacgcggcggcggcgtagcatttttgctgtcgaatctgcgagaagcgggcgcgccaattaaacgtattgaaaatcaatcttctggcgtaattccggtgatgaaaatgctggaagacgcattttcctatgccaaccaactcggcgctcgtcagggggctggtgcagtctatttacatgctcatcatcccgatattctgcgttttctcgacacgaaacgggaaaatgccgacgaaaaaatccgcattaaaacactgtcgcttggcgtggtgatcccggatatcactttccatctggcaaaagagaatgcgcagatggcgctgttttcgccttatgacgtagagcgagtttatggcaagccgtttgccgatgtggccatcagccaacactatgacgaactggttgccgatgaacgcattcgcaaaaaatacctcaacgcccgtgatttcttccagcgactggcagaaatccagtttgagtccggctatccctacatcatgtatgaagacacggtaaaccgtgctaaccctatcgccgggcgcataaatatgagtaatctctgctcagaaattttgcaggttaacagcgcctcagagtatgacgagaatctcgactatacccgcacaggccatgatatttcctgcaatttaggttcgttgaatattgcgcacaccatggattcccccgattttgcccgcacggtagagactgccgtgcgcggtttaacggcagtatcagatatgagtcatatccgcagcgtgccgtccatcgaagccggaaatgccgcctcgcacgccatcggactggggcagatgaatttacacggctatctggcgcgagaaggcatcgcttatggttcgccggaagcactggatttcaccaatctctatttctatgccatcacctggcatgcactgcgtacctcgatgttgctggcacgcgaacgcggtgaaaccttcgccgggttcaaacagtcacgctatgccagtggtgaatattttagccaatatctgcaagggaactggcagccgaaaacggcgaaagttggcgaactgtttacccgtagcggtattacgttacctacccgtgagatgtgggcgcagctgcgcgacgacgtgatgcgctacggcatatacaaccagaatcttcaggcggtgccgccaaccggttctatctcttatatcaaccatgctacgtcgagtattcatccgattgtggcgaaagtagagatacgcaaagagggcaaaacaggacgcgtttactaccctgccccgtttatgactaacgagaatctggcgctgtatcaggacgcttacgaaattggcgcagaaaagatcatcgacacctacgcggaagcgactcgccatgtcgatcaggggctgtcgctgacgctttttttccccgataccgccaccactcgcgatatcaacaaagcgcagatttacgcctggcgcaagggtatcaaaacgctctattacatccgcctgcgtcagatggcgctggaaggcactgaaattgaaggctgcgtctcctgtgcactttaa

SEQ ID NO: 47202 - DNA, 1203 bp, Escherichia coli
atggcaattaaattagaaattaaaaatctttataaaatatttggcgagcatccacagcgagcgttcaaatatatcgaacaaggactttcaaaagaacaaattctggaaaaaactgggctatcgcttggcgtaaaagacgccagtctggccattgaagaaggcgagatatttgtcatcatgggattatccggctcgggtaaatccacaatggtacgccttctcaatcgcctgattgaacccacccgcgggcaagtgctgattgatggtgtggatattgccaaaatatccgacgccgaactccgtgaggtgcgcagaaaaaagattgcgatggtcttccagtcctttgccttaatgccgcatatgaccgtgctggacaatactgcgttcggtatggaattggccggaattaatgccgaagaacgccgggaaaaagcccttgatgcactgcgtcaggtcgggctggaaaattatgcccacagctacccggatgaactctctggcgggatgcgtcaacgtgtgggattagcccgcgcgttagcgattaatccggatatattattaatggacgaagccttctcggcgctcgatccattaattcgcaccgagatgcaggatgagctggtaaaattacaggcgaaacatcagcgcaccattgtctttatttcccacgatcttgatgaagccatgcgtattggcgaccgaattgccattatgcaaaatggtgaagtggtacaggtcggcacaccggatgaaattctcaataatccggcgaatgattatgtccgtaccttcttccgtggcgttgatattagtcaggtattcagtgcgaaagatattgcccgccggacaccgaatggcttaattcgtaaaacccctggcttcggcccacgttcggcactgaaattattgcaggatgaagatcgcgaatatggctacgttatcgaacgcggtaataagtttgtcggcgcagtctccatcgattcgcttaaaaccgcgttaacgcagcagcaaggtcttgatgcggcgctgattgatgcgccgttagcagtcgatgcacaaacgcctcttagcgagttgctctctcatgtcggacaggcaccctgtgcggtgcccgtggtcgacgaggaccaacagtatgtcggcatcatttcgaaaggaatgctgctgcgcgctttagatcgtgagggggtaaataatggctga

SEQ ID NO: 47203 - DNA, 567 bp, Escherichia coli
atgtacgagcgttatgcaggtttaatttttgatatggatggcacaatcctggatacggagcctacgcaccgtaaagcgtggcgcgaagtattagggcactacggtcttcagtacgatattcaggcgatgattgcgcttaatggatcgcccacctggcgtattgctcaggcaattattgagctgaatcaggccgatctcgacccgcatgcgttagcgcgtgaaaaaacagaagcagtaagaagtatgctgctggatagcgtcgaaccgcttcctcttgttgatgtggtgaaaagttggcatggtcgtcgcccaatggctgtaggaacggggagtgaaagcgccatcgctgaggcattgctggcgcacctgggattacgccattattttgacgccgtcgtcgctgccgatcacgtcaaacaccataaacccgcgccagacacatttttgttgtgcgcgcagcgtatgggcgtgcaaccgacgcagtgtgtggtctttgaagatgccgatttcggtattcaggcggcccgtgcagcaggcatggacgccgtggatgttcgcttgctgtga

SEQ ID NO: 47204 - DNA, 780 bp, Escherichia coli
atgaatcaggttgccgttgtcatcggtggtgggcaaaccttaggcgcgttcctgtgccacggtctggctgccgaggggtatcgcgtcgcggttgtcgatattcagagcgacaaagccgcaaatgtggcacaagaaattaacgccgaatatggtgaaagtatggcgtacggttttggtgctgacgccactagcgagcaaagcgttctggcgctctctcgtggggtagatgaaatctttggtcgcgtggatttgctggtctacagcgccggaatagcaaaagcagcctttatcagcgacttccagctcggcgattttgaccgttcgctacaggtgaatctggtgggttatttcctgtgtgcgcgtgaattttcgcgtttgatgatccgcgacgggattcaggggcgcattattcagatcaactcgaaatccggcaaagtgggcagcaaacacaactctggctacagcgcagcgaaatttggtggcgtcgggctgactcaatcactggcgctggatctggcggagtacggcattacggtgcattcactgatgctcggtaacctgctgaaatcgccgatgttccagtcactgttgccacaatacgcgaccaagctgggtatcaaaccggatcaagtcgagcagtattacatcgacaaagtaccgctcaaacgcggctgcgattatcaagatgtgctgaatatgctgctgttctacgccagtcctaaggcgtcgtactgcaccggacagtcgatcaatgtcaccggcggtcaggtgatgttctga

SEQ ID NO: 47205 - DNA, 1425 bp, Escherichia coli
atgtcagtatttccagaaagttttttatggggcggcgcgcttgccgccaaccagtctgaaggtgcgttccgtgaaggtgacaaaggtctgaccactgtcgatatgatcccacacggcgagcatcgaatggcggtgaaactggggctggaaaaacgttttcagttgcgagatgacgagttttatcccagccatgaggcgacggatttttatcatcgttataaagaagatatcgccctgatggcagagatgggattcaaggttttccgtacctcaattgcctggagccgtctctttccgcagggcgatgaaatcacgcccaatcagcagggcattgctttttatcgttctgtctttgaagagtgtaaaaagtacggtatcgaaccgctggtcacgttgtgccacttcgatgtgccgatgcatctggtcaccgaatatggctcctggcgtaaccgcaagctggtggagtttttcagccgctacgccagaacctgctttgaagcatttgatggtctggtgaaatactggctaaccttcaatgaaatcaacattatgttgcatagcccgttctccggcgcgggtctggtgtttgaagaaggtgaaaatcaggatcaggtgaaatatcaggccgcgcatcaccagctggttgccagtgcgctagccaccaaaatcgcccatgaggttaacccgcaaaatcaggtgggctgtatgctggcgggcggtaacttctacccttacagttgcaagccggaagatgtctgggcggcgctggagaaagaccgggaaaacctgttttttatcgatgtgcaggcgcggggcacgtatccggcttactctgcccgcgtattccgcgaaaaaggggtaaccatcaacaaagcaccgggcgatgatgaaatcctgaaaaacaccgtcgattttgtctctttcagctattacgcctcgcgctgcgcctcggcggagatgaacgccaacaacagcagtgcggcgaacgtggtgaaatcgctgcgtaatccgtatctacaggtgagcgactggggctggggaattgatccactcggtctgcgtatcaccatgaatatgatgtacgatcgttatcagaagccgctgtttctggtggaaaacggcctgggcgcaaaagatgaatttgctgccaatggcgagattaacgacgactatcgcatcagctacttacgcgaacatatccgcgcaatgggcgaagcgattgcagacggcattccgctgatgggctacaccacatggggctgtattgatttagtttccgcctctacgggtgaaatgagcaaacgctacggctttgtctttgttgaccgtgacgacgcaggcaacggtacgctgacgcgcacgcgtaagaaatcattctggtggtataaaaaagtgattgccagtaatggggaagatttagagtag

SEQ ID NO: 47206 - DNA, 2562 bp, Escherichia coli
atgagtgcaatagaaaatttcgacgcccatacgcccatgatgcagcagtatctcaggctgaaagcccagcatcccgagatcctgctgttttaccggatgggtgatttttatgaactgttttatgacgacgcaaaacgcgcgtcgcaactgctggatatttcactgaccaaacgcggtgcttcggcgggagagccgatcccgatggcggggattccctaccatgcggtggaaaactatctcgccaaactggtgaatcagggagagtccgttgccatctgcgaacaaattggcgatccggcgaccagcaaaggtccggttgagcgcaaagttgtgcgtatcgttacgccaggcaccatcagcgatgaagccctgttgcaggagcgtcaggacaacctgctggcggctatctggcaggacagcaaaggtttcggctacgcgacgctggatatcagttccgggcgttttcgcctgagcgaaccggctgaccgcgaaacgatggcggcagaactgcaacgcactaatcctgcggaactgctgtatgcagaagattttgctgaaatgtcgttaattgaaggccgtcgcggcctgcgccgtcgcccgctgtgggagtttgaaatcgacaccgcgcgccagcagttgaatctgcaatttgggacccgcgatctggtcggttttggcgtcgagaacgcgccgcgcggactttgtgctgccggttgtctgttgcagtatgcgaaagatacccaacgtacgactctgccgcatattcgttccatcaccatggaacgtgagcaggacagcatcattatggatgccgcgacgcgtcgtaatctggaaatcacccagaacctggcgggtggtgcggaaaatacgctggcttctgtgctcgactgcaccgtcacgccgatgggcagccgtatgctgaaacgctggctgcatatgccagtgcgcgatacccgcgtgttgcttgagcgccagcaaactattggcgcattgcaggatttcaccgccgggctacagccggtactgcgtcaggtcggcgacctggaacgtattctggcacgtctggctttacgaactgctcgcccacgcgatctggcccgtatgcgccacgctttccagcaactgccggagctgcgtgcgcagttagaaactgtcgatagtgcaccggtacaggcgctacgtgagaagatgggcgagtttgccgagctgcgcgatctgctggagcgagcaatcatcgacacaccgccggtgctggtacgcgacggtggtgttatcgcatcgggctataacgaagagctggatgagtggcgcgcgctggctgacggcgcgaccgattatctggagcgtctggaagtccgcgagcgtgaacgtaccggcctggacacgctgaaagttggctttaatgcggtgcacggctactacattcaaatcagccgtgggcaaagccatctggcacccatcaactacatgcgtcgccagacgctgaaaaacgccgagcgctacatcattccagagctaaaagagtacgaagataaagttctcacctcaaaaggcaaagcactggcactggaaaaacagctttatgaagagctgttcgacctgctgttgccgcatctggaagcgttgcaacagagcgcgagcgcgctggcggaactcgacgtgctggttaacctggcggaacgggcctataccctgaactacacctgcccgaccttcattgataaaccgggcattcgcattaccgaaggtcgccatccggtagttgaacaagtactgaatgagccatttatcgccaacccgctgaatctgtcgccgcagcgccgcatgttgatcatcaccggtccgaacatgggcggtaaaagtacctatatgcgccagaccgcactgattgcgctgatggcctacatcggcagctatgtaccggcacaaaaagtcgagattggacctatcgatcgcatctttacccgcgtaggcgcggcagatgacctggcgtccgggcgctcaacctttatggtggagatgactgaaaccgccaatattttacataacgccaccgaatacagtctggtgttaatggatgagatcgggcgtggaacgtccacctacgatggtctgtcgctggcgtgggcgtgcgcggaaaatctggcgaataagattaaggcattgacgttatttgctacccactatttcgagctgacccagttaccggagaaaatggaaggcgtcgctaacgtgcatctcgatgcactggagcacggcgacaccattgcctttatgcacagcgtgcaggatggcgcggcgagcaaaagctacggcctggcggttgcagctctggcaggcgtgccaaaagaggttattaagcgcgcacggcaaaagctgcgtgagctggaaagcatttcgccgaacgccgccgctacgcaagtggatggtacgcaaatgtctttgctgtcagtaccagaagaaacttcgcctgcggtcgaagctctggaaaatcttgatccggattcactcaccccgcgtcaggcgctggagtggatttatcgcttgaagagcctggtgtaa

SEQ ID NO: 47207 - DNA, 627 bp, Escherichia coli
atggtaagcagacgcgtacaagcacttctggatcaattacgtgcgcaaggtattcaggatgagcaggtgctgaatgcacttgccgccgtgccgcgtgaaaaattcgttgatgaagcgtttgaacaaaaagcctgggacaatatcgctttgccgataggtcaggggcagacaatttcgcagccatatatggtggcgcgaatgaccgaattactcgagctgacgccgcagtcgcgggtgctggaaattggcaccggttcgggatatcaaacggcaatcctggcgcatcttgtccagcatgtttgctcggttgaacggattaaaggcttgcagtggcaggcacgtcgccgcctgaaaaatcttgatttacataatgtttcaacccgtcatggcgatggatggcaaggttggcaggcacgtgcgccgtttgacgctatcattgttacggcggcaccgccggaaattccaactgcgctaatgacgcagctggacgaaggcgggattctcgtcttacccgtaggggaggagcaccagtatttgaaacgggtgcgtcgtcggggaggcgaatttattatcgataccgtggaggccgtgcgctttgtccctttagtgaagggtgagctggcttaa

SEQ ID NO: 47208 - DNA, 606 bp, Escherichia coli
atggcgctgcatgacgaaaacgtcgtctggcatagccatccggtcactgtgcaacaacgcgagctacaccacggtcatcgtggtgtagtgctgtggtttaccggcctctccgggtccggtaaatcaacggtcgccggggcgctggaggaggcgttacataaactcggcgtcagtacgtatctgctggatggcgacaatgttcgccacggattatgcagcgatctcggttttagcgatgccgatcgtaaagagaatatccgtcgcgtcggtgaagtggcgaatttgatggttgaagccggactggtggtgctgaccgcatttatctcgccacaccgcgccgaacgccagatggttcgcgaacgcgtaggagaagggcgctttatcgaagtgtttgtcgatacgccgctggcgatttgcgaagcccgcgatcccaaaggcttatataagaaagcgcgtgccggtgaactgcgcaactttacgggaatagattccgtttacgaagcgcctgaatcggcagaaattcatctcaatggtgaacaattagtaacaaatttggtacagcaattattagatctgttgagacagaacgatattatcagatcctga

SEQ ID NO: 47209 - DNA, 735 bp, Escherichia coli
atgtccaaactcgatctaaacgccctgaacgaactgccgaaggtagatcgcattctggcgctggcggaaactaacgccgaactggaaaaactggacgctgaaggccgcgtagcctgggcgctggataatctgcccggtgaatatgtactttcttccagctttggcattcaggcggcggtgagcctgcatctggtgaatcaaattcgcccggatattccggtgatcctcaccgatacgggttacttgttcccggaaacctaccgctttattgacgagttaacggacaaactcaagctcaacctgaaagtgtaccgtgctaccgaaagcgcagcctggcaggaagcacgctacggaaaactgtgggagcagggcgttgaaggcattgaaaagtacaatgacatcaacaaagtcgaaccgatgaaccgggctctgaaagaactgaatgcgcaaacctggtttgctggcctgcgccgtgaacaatccggcagtcgtgccaatttaccggtgctggcaattcagcgtggcgtatttaaagtgctgccgattatcgactgggataaccgaactatttatcagtacctgcaaaaacatggcctgaaatatcacccattatgggatgaaggatatttatcggtgggcgatacccatacaacccgtaaatgggaacccggcatggcggaagaagaaacgcgtttctttggcttaaaaagggaatgtgggttacacgaagggtaa

SEQ ID NO: 47210 - DNA, 1713 bp, Escherichia coli
atgagcgaaaaacatccagggcctttagtggtcgaaggaaaactgacagacgccgagcgcatgaagcatgaaagcaactacctgcgcggcaccattgcggaagatttaaacgacggtctgaccggcggctttaagggcgacaacttcctgctgattcgcttccacggcatgtatcagcaggatgaccgcgacatccgcgccgaacgtgctgaacagaagctggagccgcgccacgcgatgctgcttcgctgtcgtctgccgggtggggtgattaccactaaacagtggcaggcgatcgacaaatttgccggtgaaaacaccatctatggcagcattcgcctgaccaaccgccagacgtttcagttccacggcattctgaaaaagaacgtcaaaccggtgcaccagatgctgcactcggtcggtcttgatgcgctggcgacagctaacgacatgaaccgtaacgtactctgcacctcgaacccttacgagtcgcagctgcacgcggaagcgtacgagtgggcgaagaagatttctgagcatctgttgcctcgtacccgcgcgtatgcggagatctggctcgaccaggaaaaagtcgccactactgatgaagaaccgatcctcggccagacctacctgccgcgtaaattcaaaaccacggtagtgatcccgccacagaacgatatcgatctgcacgccaacgacatgaacttcgtggcgatcgccgaaaacggcaagctggtgggctttaacctgttggtgggcggtgggctttccatcgaacacggcaacaagaaaacctacgcccgcaccgcgagtgagtttggctatctgccgctggagcatacgctggcggtggccgaagccgtcgtgacaactcagcgtgactggggtaaccgaaccgatcgtaaaaatgccaaaaccaaatacacgctggagcgcgtgggggttgagacgtttaaagcggaagtggagcgtcgcgcggggatcaaatttgaaccgatccgtccatatgagttcaccggacgaggcgatcgtattggctgggttaagggcattgatgataactggcacctgacgctgtttatcgaaaatggtcgcatccttgattatccggcgcgtccgctgaaaaccggcctgctggagatcgcgaagatccacaaaggcgatttccgcattacggcgaaccagaatctgatcatcgccggtgtaccggaaagcgagaaagcgaagatcgagaagatcgccaaagagagcgggttaatgaatgccgtcacgccgcagcgtgaaaactcgatggcttgcgtgtcattcccgacttgcccgctggcgatggcggaagcagagcgtttcctgccgtcttttatcgacaacatcgataatttaatggcgaaacatggtgtcagcgatgagcatatcgtgatgcgtgtaacaggctgcccgaacggttgtggtcgcgcgatgctggcggaagtgggcctggtgggtaaagcgccgggtcgctacaacctgcatcttggcggcaaccgcattgggacacgtatcccacggatgtataaagaaaacatcaccgagccggaaatcctggcgtcgcttgatgaactgatagggcgctgggcgaaagagcgcgaagcgggtgaaggcttcggcgactttacggtgcgtgcgggcatcattcgcccggtgctcgatccggcgcgtgatttgtgggattaa

SEQ ID NO: 47211 - DNA, 366 bp, Escherichia coli
atgatgtccaccacgttatttaaagatttcaccttcgaagccgctcaccgcttaccacacgtcccggaagggcataaatgtggtcgcctgcacgggcattcctttatggtgcgactggaaattaccggggaagtcgatccgcatacgggctggattatcgatttcgctgaactaaaagcggcgtttaaaccaacctacgagcgcctcgatcaccattatctcaatgatattccaggtctggaaaacccaaccagcgaggttttagcaaaatggatttgggatcaggttaaacccgttgtgccgctgttaagtgcggtgatggtaaaagaaacctgcaccgcaggttgtatctatcgcggcgaatga

SEQ ID NO: 47212 - DNA, 861 bp, Escherichia coli
atgagaaaggtaacttccctctcgcgggggaagttacctttctttttttttgccttacggaaattggagctaactatgtcaatcgaatctctcaatgcgttctcaatggattttttctccctgaaaggtaaaaccgcaattgttaccggtgggaatagcggtttaggccaggcatttgccatggcgttggccaaagctggcgcaaatatctttattcctagtttcgtcaaagataacggcgaaacaaaggaaatgattgaaaaacagggtgttgaggtggacttcatgcaggtgggtatcaccgcagaaggcgcgccgcagaagattatcgctgcttgctgtgagcgtttcggtacagttgatattctggttaacaatgccggtatttgtaagctgaataaggtgctggacttcggtcgtgccgactgggatccgatgattgatgtgaacctgaccgccgcattcgagttaagctatgaagctgcaaaaattatgatcccgcagaaaagcggcaaaattattaatatctgttcattgttctcttacttaggtggacaatggtcacctgcatattctgccactaaacatgctcttgccgggttcaccaaagcttattgtgatgaactaggtcaatataatattcaggtaaatggtatcgcccctggctattatgcaacagatattacgctggcgacacgcagtaatccagaaaccaatcagcgcgttcttgatcatattccggcaaaccgttggggcgatactcaggatttaatgggcgcagccgtattcctcgcaagtccggcatcgaattatgtcaacgggcatttattagtggttgatggcggttatttagtgcgctaa

SEQ ID NO: 47213 - DNA, 1479 bp, Escherichia coli
atgtcgaaaaaatacatcatagggattgatggcggaagtcagagcacaaaagtggtgatgtacgatctggaaggtaacgtggtttgcgaaggcaaaggcttattacagccgatgcacacgccagatgccgatactgcagaacatcctgacgacgatttatgggcatcattatgttttgccggtcacgatttgatgagtcagtttgccgggaataaagaagatattgtcggtattggtctgggatccatccgttgctgccgtgcgttattgaaagccgatggcacgcctgctgcgccgttgattagctggcaggatgcacgcgttacacgcccttacgaacacactaaccctgacgtggcatatgtcacctctttttcgggttatctgacgcatcgcttaaccggcgagtttaaagacaatatcgccaactattttggtcagtggccggtggattataagagctgggcatggagcgaagatgctgcggtaatggataagtttaatatcccccgtcatatgctgtttgatgtgcaaatgcctggcaccgtcctcggacatatcacaccacaagccgcactggcgacacatttcccggcaggactgccggttgtttgtaccaccagtgataaaccggtagaagctctgggggccggattactggatgatgaaacggcggtaatttctcttggcacttacatcgcattgatgatgaacggcaaagcactgccgaaagatccagtagcgtactggccgattatgtcttctattccgcaaacattgctgtatgaaggttacggtattcgcaaaggcatgtggacggtgagctggctgcgcgacatgctaggcgagtcgttaattcaggatgccagggcgcaggatctttcaccggaagatttactcaacaaaaaagcttcttgtgtgccgccaggctgtaatggtctgatgacggtgctggactggctgaccaatccgtgggaaccgtacaaacgcgggattatgatcggctttgattccagcatggattacgcatggatatatcgttcgatactggaaagcgtggcgctgacgctgaagaacaattacgacaatatgtgtaatgaaatgaatcactttgcgaagcatgtgatcattactggcggcggttcgaacagcgatctgtttatgcagatttttgccgacgtgttcaaccttccggcacgacgtaacgccattaacggttgtgcaagcctgggggcagcgattaatacagcggtaggtctggggctatacccggattacgcaacggctgtcgataacatggttcgcgtgaaagatatctttataccgattgagagcaatgccaaacgctacgacgcgatgaataaaggcattttcaaagacctaaccaaacatactgatgtgatcctgaaaaaatcgtatgaagtgatgcatggggaattggggaatgtggattcgatccagagctggtcgaatgcgtaa

SEQ ID NO: 47214 - DNA, 1299 bp, Escherichia coli
atgtccaaaatcgtaaaaatcatcggtcgtgaaatcatcgactcccgtggtaacccgactgttgaagccgaagtacatctggagggtggtttcgtcggtatggcagctgctccgtcaggtgcttctactggttcccgtgaagctctggaactgcgcgatggcgacaaatcccgtttcctgggtaaaggcgtaaccaaagctgttgctgcggtaaacggcccgatcgctcaggcgctgattggcaaagatgctaaagatcaggctggcattgacaagatcatgatcgacctggacggcaccgaaaacaaatccaaattcggcgcgaacgcaatcctggctgtatctctggctaacgccaaagctgctgcagctgctaaaggtatgccgctgtacgagcacatcgctgaactgaacggtactccgggcaaatactctatgccggttccgatgatgaacatcatcaacggtggtgagcacgctgacaacaacgttgatatccaggaattcatgattcagccggttggcgcgaaaactgtgaaagaagccatccgcatgggttctgaagttttccatcacctggcaaaagttctgaaagcgaaaggcatgaacactgctgttggtgacgaaggtggctatgcgccgaacctgggttccaacgctgaagctctggctgttatcgctgaagctgttaaagctgctggttatgaactgggcaaagacatcactttggcgatggactgcgcagcttctgaattctacaaagatggtaaatacgttctggctggcgaaggcaacaaagcgttcacctctgaagaattcactcacttcctggaagaactgaccaaacagtacccgatcgtttctatcgaagacggtctggacgaatctgactgggacggtttcgcataccagaccaaagttctgggcgacaaaatccagctggttggtgacgacctgttcgtaaccaacaccaagatcctgaaagaaggtatcgaaaaaggtatcgctaactccatcctgatcaaattcaaccagatcggttctctgaccgaaactctggctgcaatcaagatggcgaaagatgctggctacactgcagttatctctcaccgttctggcgaaactgaagacgctaccatcgctgacctggctgttggtactgctgcaggccagatcaaaactggttctatgagccgttctgaccgtgttgctaaatacaaccagctgattcgtatcgaagaagctctgggcgaaaaagcaccgtacaacggtcgtaaagagatcaaaggccaggcataa

SEQ ID NO: 47215 - DNA, 2757 bp, Escherichia coli
atgaccaactacagcctgcgcgcacgcatgatgattctgatcctggcaccgaccgtccttattggtttattgctgagtatctttttcgtcgtgcatcgctataacgacttgcagcgtcaactggaagatgccggtgccagcattattgagccgcttgcagtttctactgaatatggcatgagcctgcaaaatcgcgaatctatcggtcagttaataagcgtactgcatcgtcgccattccgatattgttcgcgcgatttcggtttatgatgaaaataaccgactctttgtcacctccaattttcatcttgatccctcatcaatgcagctcggcagcaacgtgccgtttcctcgccagctcactgtcactcgtgacggcgatattatgatcctccgcacgccgattatttctgagagttactcccccgacgaatcgcccagtagcgatgccaaaaatagtcaaaatatgttgggatatattgcgctggagctggatcttaaatcggttcgcttgcagcaatataaagagatctttatttccagcgtgatgatgctgttttgtatcggtattgcgcttatttttggctggcgcttaatgcgcgatgtaaccggtccgattcgcaacatggtgaataccgtcgaccgcatccgtcgcgggcaactcgacagccgggtggaaggatttatgctcggcgagctggatatgctgaaaaacggtatcaactcgatggcaatgtcgctggctgcttatcacgaagagatgcagcacaatatcgaccaggcgacgtccgatctgcgtgaaacgctggagcagatggaaattcagaacgttgagttagatctggcgaaaaagcgcgcccaggaagcggcgcgtattaaatccgagtttctggcaaatatgtcacacgagctgcgtacaccactgaatggtgttattggctttacccgcctgacgctgaaaacagaattaacaccaacgcagcgcgatcacctgaatacgattgaacgttcggcaaataatttgctggcaattattaatgatgttctcgacttctcgaaactggaagcaggtaagctgattctggaaagtattccattcccactacgcagcacgctggatgaagtcgttactctgctggcacattcttctcacgataaagggttagaactgacgctcaatattaaaagcgacgtgcctgataacgtgatcggcgacccgctgcgattacagcaaatcatcactaacctggtggggaatgcaattaaattcaccgagaatggcaacattgatattctggtagaaaaacgtgcgctgagtaataccaaagtgcagattgaagtgcagattcgggataccggcattggtattcctgaacgcgatcaatcgcgcttattccaggccttccgacaggctgatgccagtatttcccgccgtcatggtggcaccgggctggggctggtgattacacaaaaactggttaatgaaatgggcggcgatatttcgttccatagccagccgaatcgcggttcaactttctggttccacattaatctcgatctgaacccgaacattattatcgaagggccatccacccagtgcctcgcaggtaagcgcctggcctatgtcgaaccaaactccgcagcagcgcaatgcacgctggatattttaagtgaaacgccgctggaagtggtttatagcccaacgttctccgcgctgcctcccgcgcattacgacatgatgttgttaggcatcgcggtgaccttccgcgagccgctaacaatgcaacatgagcgattagcgaaagcggtatcgatgaccgatttcctgatgctggcacttccttgccatgcacaagtcaatgctgaaaaactcaagcaagatggtatcggcgcgtgtctgctgaaaccattaacacctacacgcctgttgcctgccctgacggaattttgtcatcacaaacaaaacacgcttttgcctgtaaccgatgaaagtaagctggcaatgacagtcatggcggttgatgacaaccccgctaacctgaaacttatcggcgcattgctggaagatatggtgcaacatgtggaactttgcgatagcgggcatcaggcggttgaacgggcgaaacagatgccgttcgatttgatcttaatggatattcaaatgccggacatggatggcattcgggcctgcgaactcatccaccaactcccgcatcagcaacaaacgccggttatcgcggtaacggcgcatgcaatggccgggcaaaaagagaagctgcttggcgcagggatgagcgattatctggcgaaaccgattgaagaagagcgattgcataatttgttgttgcgctacaagcctggcagcggtatttcctctcgcgtcgtgacgcccgaagtcaacgaaattgtggtgaacccgaatgcgaccctcgactggcaactggcactacgccaggcagcaggaaaaaccgatttagcgcgcgatatgctgcaaatgttactcgatttcctgcctgaagttcgcaacaaagttgaggaacagctggttggagaaaacccggaaggcctggttgatttgattcataaactgcatggcagttgcggctatagcggtgtgccacgtatgaagaatctctgccaactgatcgaacaacagctacgtagcggtactaaagaagaagatttggaaccggagctgctggaactgttggacgagatggataatgtcgcgcgcgaagccagcaaaattctcgggtaa

SEQ ID NO: 47216 - DNA, 1353 bp, Escherichia coli
atgagttctttaagtcaggctgcgagcagtgtggaaaaacgcacaaatgctcgttactggatagtggtgatgttgtttatcgtcacatccttcaactacggcgaccgcgctacgctctctatcgccggttcggaaatggccaaagatatcggccttgatcccgtgggaatgggctatgtgttctctgctttctcatgggcttatgttatcgggcagatccctggtggctggttgctggaccgttttggttcaaaacgcgtctacttctggtcgatctttatctggtcgatgtttaccttgctgcaaggcttcgtcgatatctttagtggattcggcattatcgttgccctgtttacgctgcgcttcctggtcgggcttgctgaagcgccatctttccccggcaacagtcgcattgttgcggcctggtttccggcgcaggaaaggggaacggcggtgtcgatttttaactccgctcaatacttcgcaacggtgatcttcgcgccgattatgggctggctgacgcatgaagtgggctggtcacacgtcttcttctttatgggcggtctggggattgtcatcagctttatctggttgaaagtcatccacgagccaaatcaacatccgggggtaaataagaaagagctggagtacatcgccgcgggtggtgcgctgatcaatatggatcagcaaaacaccaaagttaaagtgccgttcagcgtgaagtgggggcagatcaaacagctgctagggtcacggatgatgatcggcgtttatatcggtcagtactgtatcaacgccctgacttacttctttattacctggttcccggtttatctggtgcaggcacgcgggatgtcgattctgaaagcgggctttgtggcttccgttccggcggtttgcggttttatcggcggtgtgctgggtgggattatttccgactggctgatgcgccgcacgggatcgctgaacattgcgcgtaaaacaccgatcgtaatgggcatgttgctgtcgatggtgatggtgttctgcaactacgtcaacgttgagtggatgatcatcggctttatggcgctggccttcttcggtaagggcatcggggcgctgggttgggcagtaatggcagataccgcgccaaaagagatcagcggtctttccggtggcctgttcaacatgttcggtaacatttctggcatcgtcacgccaatcgcaattggttatatcgttggcacgactggctcgtttaatggggcgctgatttatgttggtgttcatgccttaatcgcggtactgagctacctggtgctggtgggcgatatcaagcgtatcgagttgaaacctgttgcggggcaataa

SEQ ID NO: 47217 - DNA, 1152 bp, Escherichia coli
atgatggctaacagaatgattctgaacgaaacggcatggtttggtcggggtgctgttggggctttaaccgatgaggtgaaacgccgtggttatcagaaggcgctgatcgtcaccgataaaacgctggtgcaatgcggcgtggtggcgaaagtgaccgataagatggatgctgcagggctggcatgggcgatttacgacggcgtagtgcccaacccaacaattactgtcgtcaaagaagggctcggtgtattccagaatagcggcgcggattacctgatcgctattggtggtggttctccacaggatacttgtaaagcgattggcattatcagcaacaacccggagtttgccgatgtgcgtagcctggaagggctttccccgaccaataaacccagtgtaccgattctggcaattcctaccacagcaggtactgcggcagaagtgaccattaactacgtgatcactgacgaagagaaacggcgcaagtttgtttgcgttgatccgcatgatatcccgcaggtggcgtttattgacgctgacatgatggatggtatgcctccagcgctgaaagctgcgacgggtgtcgatgcgctcactcatgctattgaggggtatattacccgtggcgcgtgggcgctaaccgatgcactgcacattaaagcgattgaaatcattgctggggcgctgcgaggatcggttgctggtgataaggatgccggagaagaaatggcgctcgggcagtatgttgcgggtatgggcttctcgaatgttgggttagggttggtgcatggtatggcgcatccactgggcgcgttttataacactccacacggtgttgcgaacgccatcctgttaccgcatgtcatgcgttataacgctgactttaccggtgagaagtaccgcgatatcgcgcgcgttatgggcgtgaaagtggaaggtatgagcctggaagaggcgcgtaatgccgctgttgaagcggtgtttgctctcaaccgtgatgtcggtattccgccacatttgcgtgatgttggtgtacgcaaggaagacattccggcactggcgcaggcggcactggatgatgtttgtaccggtggcaacccgcgtgaagcaacgcttgaggatattgtagagctttaccataccgcctggtaa

SEQ ID NO: 47218 - DNA, 1449 bp, Escherichia coli
atgttatccggctatattgcaggagcgattatgaaacaagaagttatcctggtactcgactgtggcgcgaccaatgtcagggccatcgcggttaatcggcagggcaaaattgttgcccgcgcctcaacgcctaatgccagcgatatcgcgatggaaaacaacacctggcaccagtggtctttagacgccattttgcaacgctttgctgattgctgtcggcaaatcaatagtgaactgactgaatgccacatccgcggtatcgccgtcaccacctttggtgtggatggcgctctggtagataagcaaggcaatctgctctatccgattattagctggaaatgtccgcgaacagcagcggttatggacaatattgaacggttaatctccgcacagcggttgcaggctatttctggcgtcggagcctttagtttcaatacgttatataagttggtgtggttgaaagaaaatcatccacaactgctggaacgcgcgcacgcctggctctttatttcgtcgctgattaaccaccgtttaaccggcgaattcactactgatatcacgatggccggaaccagccagatgctggatatccagcaacgcgatttcagtccgcaaattttacaagccaccggtattccacgccgactcttccctcgtctggtggaagcgggtgaacagattggtacgctacagaacagcgccgcagcaatgctcggcttacccgttggcataccggtgatttccgcaggtcacgatacccagttcgccctttttggcgctggtgctgaacaaaatgaacccgtgctctcttccggtacatgggaaattttaatggttcgcagcgcccaggttgatacttcgctgttaagtcagtacgccggttccacctgcgaactggatagccaggcagggttgtataacccaggtatgcaatggctggcatccggcgtgctggaatgggtgagaaaactgttctggacggctgaaacaccctggcaaatgttgattgaagaagctcgtctgatcgcgcctggcgcggatggcgtaaaaatgcagtgtgatttattgtcgtgtcagaacgctggctggcaaggagtgacgcttaataccacgcgggggcatttctatcgcgcggcgctggaagggttaactgcgcaattacagcgcaatctacagatgctggaaaaaatcgggcactttaaggcctctgaattattgttagtcggtggaggaagtcgcaacacattgtggaatcagattaaagccaatatgcttgatattccggtaaaagttctcgacgacgccgaaacgaccgtcgcaggagctgcgctgttcggttggtatggcgtaggggaatttaacagcccggaagaagcccgcgcacagattcattatcagtaccgttatttctacccgcaaactgaacctgaatttatagaggaagtgtga

SEQ ID NO: 47219 - DNA, 1332 bp, Escherichia coli
gtggtaaaggaacgtaaaaccgagttggtcgagggattccgccattcggttccctatatcaatacccaccggggaaaaacgtttgtcatcatgctcggcggtgaagccattgagcatgagaatttctccagtatcgttaatgatatcgggttgttgcacagcctcggcatccgtctggtggtggtctatggcgcacgtccgcagatcgacgcaaatctggctgcgcatcaccacgaaccgctgtatcacaagaatatacgtgtgaccgacgccaaaacactggaactggtgaagcaggctgcgggaacattgcaactggatattactgctcgcctgtcgatgagtctcaataacacgccgctgcagggcgcgcatatcaacgtcgtcagtggcaattttattattgcccagccgctgggcgtcgatgacggcgtggattactgccatagcgggcgtatccggcggattgatgaagacgcgatccatcgtcaactggacagcggtgcaatagtgctaatggggccggtcgctgtttcagtcactggcgagagctttaacctgacctcggaagagattgccactcaactggccatcaaactgaaagctgaaaagatgattggtttttgctcttcccagggcgtcactaatgacgacggtgatattgtctccgaacttttccctaacgaagcgcaagcgcgggtagaagcccaggaagagaaaggcgattacaactccggtacggtgcgctttttgcgtggcgcagtgaaagcctgccgcagcggcgtgcgtcgctgtcatttaatcagttatcaggaagatggcgcgctgttgcaagagttgttctcacgcgacggtatcggtacgcagattgtgatggaaagcgccgagcagattcgtcgcgcaacaatcaacgatattggcggtattctggagttgattcgcccactggagcagcaaggtattctggtacgccgttctcgcgagcagctggagatggaaatcgacaaattcaccattattcagcgcgataacacgactattgcctgcgccgcgctctatccgttcccggaagagaagattggggaaatggcctgtgtggcagttcacccggattaccgcagttcatcaaggggtgaagttctgctggaacgcattgccgctcaggcgaagcagagcggcttaagcaaattgtttgtgctgaccacgcgcagtattcactggttccaggaacgtggatttaccccagtggatattgatttactgcccgagagcaaaaagcagttgtacaactaccagcgtaaatccaaagtgttgatggcggatttagggtaa

SEQ ID NO: 47220 - DNA, 2889 bp, Escherichia coli
atgccccgcagcacctggttcaaagcattattgttgttagttgccctttgggcacccttaagtcaggcagaaacgggatggcagccgattcaggaaaccatccgtaaaagtgataaagataaccgccagtatcaggctatacgtctggataacggtatggtggtcttgctggtttctgatccgcaggcagttaaatcgctctcggcgctggtggtgcccgttgggtcgctggaagatcccgaggcgtaccaggggctggcacattaccttgaacatatgagtctgatggggtcgaaaaagtacccgcaggctgacagtctggccgaatatctcaaaatgcacggcggtagtcacaatgccagcactgcgccgtatcgcacggctttctatctggaagttgagaacgacgccttgcctggtgcggtagaccgcctggccgatgctattgctgaacctttgctcgacaagaaatatgccgaacgtgagcgtaatgcggtgaacgctgaattaaccatggcgcgtacgcgtgacgggatgcgcatggcacaggtcagcgcagaaaccattaacccggcacaccccggttcaaagttttctggtggtaacctcgaaactttaagcgacaaacctggtaatccggtgcagcaggcgctgaaagatttccacgagaagtactattccgccaatttgatgaaggcggttatttacagtaataaaccgctgccggagttggcaaaaatggcggcggacacctttggtcgcgtgccgaacaaagagagcaaaaaaccggaaatcaccgtgccggtagtcaccgacgcgcaaaagggcattatcattcattacgtccctgcgctgccgcgtaaagtgttgcgcgttgagtttcgcatcgataacaactcagcgaagttccgtagtaaaaccgatgaattgattacctatctgattggcaatcgcagcccaggtacactttctgactggctgcaaaagcagggattagttgagggcattagcgccaactccgatcctatcgtcaacggcaacagcggcgtattagcgatctctgcgtctttaaccgataaaggcctggctaatcgcgatcaggttgtggcggcaatttttagctatctcaatctgttacgtgaaaaaggcattgataaacaatacttcgatgaactggcgaatgtgctggatatcgacttccgttatccgtcgatcacccgtgatatggattacgtcgaatggctggcagataccatgattcgcgttcctgttgagcatacgctggatgcagtcaatattgccgatcggtacgatgctaaagcagtaaaggaacgtctggcgatgatgacgccgcagaatgcgcgtatctggtatatcagcccgaaagagccgcacaacaaaacggcttactttgtcgatgcgccgtatcaggtcgataaaatcagcgcacaaactttcgccgactggcagaaaaaagccgccgacattgcgctctctttgccagagcttaacccttatattcctgatgatttctcgctgattaagtcagagaagaaatacgaccatccagagctgattgttgatgagtcgaatctgcgcgtggtgtatgcgccaagccgttattttgccagcgagcccaaagctgatgtcagcctgattttgcgtaatccgaaagccatggacagcgcccgcaatcaggtgatgtttgcgctcaatgattatctcgcagggctggcgcttgatcagttaagcaaccaggcgtcggttggtggcataagtttttccaccaacgctaacaacggccttatggttaatgctaatggttacacccagcgtctgccgcagctgttccaggcattgctcgaggggtactttagctataccgctacggaagatcagcttgagcaggcgaagtcctggtataaccagatgatggattccgcagaaaagggtaaagcgtttgagcaggcgattatgcccgcgcagatgctctcgcaagtgccgtacttctcgcgagatgaacggcgtaaaattttgccctccattacgttgaaagaggtgctggcctatcgcgacgccttaaaatcaggggctcgaccagagtttatggttatcggcaacatgaccgaggcccaggcaacaacgctggcacgcgatgtgcaaaaacagttgggcgctgatggttcagagtggtgtcgaaacaaagatgtagtggtcgataaaaaacaatccgtcatctttgaaaaagccggtaacagcaccgactccgcactggcagcggtatttgtaccgactggctacgatgaatacaccagctcagcctatagctctctgttggggcagatcgtacagccgtggttctacaatcagttgcgtaccgaagaacaattgggctatgccgtgtttgcgtttccaatgagcgtggggcgtcagtggggcatgggcttccttttgcaaagcaatgataaacagccttcattcttgtgggagcgttacaaggcgtttttcccaaccgcagaggcaaaattgcgagcgatgaagccagatgagtttgcgcaaatccagcaggcggtaattacccagatgctgcaggcaccgcaaacgctcggcgaagaagcatcgaagttaagtaaagatttcgatcgcggcaatatgcgcttcgattcgcgtgataaaatcgtggcccagataaaactgctgacgccgcaaaaacttgctgatttcttccatcaggcggtggtcgagccgcaaggcatggctattctgtcgcagatttccggcagccagaacgggaaagccgaatatgtacaccctgaaggctggaaagtgtgggagaacgtcagcgcgttgcagcaaacaatgcccctgatgagtgaaaagaatgagtga

SEQ ID NO: 47221 - DNA, 2247 bp, Escherichia coli
atgctcactcgcctgcgcgaaatagtcgaaaaggtagccagcgcaccacgcctgaatgaggcgttaaatattctggttaccgacatctgtcttgcgatggataccgaggtctgttcggtctacctggccgatcatgatcgacgttgttactacctgatggcgacccgggggctgaaaaaaccacgcggtcgcactgtaacgctcgcgtttgatgaagggatcgtcggcctggttggcaggctggcggaaccgataaaccttgcagatgcgcaaaagcaccccagcttcaaatacatcccctccgtaaaagaagaacgtttccgcgcgtttttaggcgtaccaattattcaacgtcgccagttgcttggtgtactggtggtacagcaacgagagttgcgccagtatgacgaaagtgaagaatccttcctggtgacgcttgccacccagatggcagctattctttctcagtcgcagttgactgccttgtttgggcaatatcgccagacgcgaatccgcgcattaccggcagcacctggtgtggcgattgccgaaggctggcaggatgccacgttacctttaatggaacaggtgtatcaggcatcaacgctggatccggctctggaacgcgaacgactgaccggggcgctggaagaagcggcaaacgagtttcgccgctacagcaaacgctttgccgccggtgcacaaaaagaaacggcggctattttcgatctttactcgcacctgctttcggacacccggctgcgtcgcgaattgtttgccgaggttgataaaggctcggtggcagagtgggcggtaaaaacggtcattgaaaaatttgccgaacagtttgccgcgctaagtgataactatctcaaagagcgggctggcgatttacgtgcgctgggtcagcgattgctgtttcatcttgatgacgctaatcaagggccgaacgcctggccggaacgtttcattctggtggcagatgaactgtcagcgacaacgcttgctgagctgccccaggatcgcttagtcggtgttgtcgtgcgagatggcgcagccaactcccatgctgcgatcatggtacgtgcgctggggatccctaccgtgatgggcgcggatattcagccttcggtgctgcatcgtaggacgctgatcgttgatggctatcgcggtgaattgctggtcgatccggagccggtactgctgcaagaatatcagcggctaattagtgaagagattgagcttagccgtctggcggaagatgacgtcaatttacccgcgcagttaaaaagcggtgagcgtataaaagtcatgctcaatgctggtttaagcccggaacatgaagaaaaactgggcagccgtattgatggcatcggtctttatcgcactgaaatcccattcatgctgcaaagtggtttcccgtcggaagaagaacaggtggcgcagtatcaggggatgctgcaaatgttcaatgataaacccgtcaccttgcgtacgctggatgtcggagcagataagcagctgccttacatgccgatcagcgaagagaatccatgcctgggttggcgtgggattcgcattacgctcgatcagccggagatcttcttgatccaggtgcgggcgatgctgcgtgctaatgccgctacgggcaacctgaatattctgttgccgatggtcacaagcctcgatgaagttgatgaagcacgccgcctgattgaacgtgccggacgtgaagtcgaggagatgatcggttacgaaattcccaaaccacgtatcggcatcatgctggaagtgccgtcaatggtatttatgctgccgcatctggcaaagcgggtcgatttcatctctgttggcaccaacgatctgactcaatacattctggccgttgatcgcaacaatacccgggtggcgaacatttatgacagtcttcatcctgcaatgttacgagctctggcgatgatcgcccgggaagcggaaatacatggaatcgatctccgtttgtgcggtgaaatggcgggcgatcccatgtgcgtggcaatcctcattgggcttgggtatcgccatctgtctatgaacggacgttctgtagcgcgggcaaaatacctgctgcggcgcattgattatgccgaagcagaaaatcttgcgcagcgtagtctggaagcgcaactggcgaccgaagttcgccatcaggttgcagcctttatggagcgtcgcggcatgggcgggctgattcgcggagggttatag

SEQ ID NO: 47222 - DNA, 1263 bp, Escherichia coli
atgccacattcactgttcagcaccgataccgatctcaccgccgaaaatctgctgcgtttgcccgctgaatttggctgcccggtgtgggtctacgatgcgcaaattattcgtcggcagattgcagcgctgaaacagtttgatgtggtgcgctttgcacagaaagcctgttccaatattcatattttgcgcttaatgcgtgagcagggcgtgaaagtggattccgtctcgttaggcgaaatagagcgtgcgttggcggcgggttacaatccgcaaacgcaccccgatgatattgtttttacggcagatgttatcgatcaggcgacgcttgaacgcgtcagtgaattgcaaattccggtgaatgcgggttctgttgatatgctcgaccaactgggccaggtttcgccagggcatcgggtatggctgcgcgttaatccggggtttggtcacggacatagccaaaaaaccaataccggtggcgaaaacagcaagcacggtatctggtacaccgatctgcccgccgcactggacgtgatacaacgtcatcatctgcagctggtcggcattcacatgcacattggttctggcgttgattatgcccatctggaacaggtgtgtggtgctatggtgcgtcaggtcatcgaattcggtcaggatttacaggctatttctgcgggcggtgggctttctgttccttatcaacagggtgaagaggcggttgataccgaacattattatggtctgtggaatgccgcgcgtgagcaaatcgcccgccatttgggccaccctgtgaaactggaaattgaaccgggtcgcttcctggtagcgcagtctggcgtattaattactcaggtgcggagcgtcaaacaaatggggagccgccactttgtgctggttgatgccgggttcaacgatctgatgcgcccggcaatgtacggtagttaccaccatatcagtgccctggcagctgatggtcgttctctggaacacgcgccaacggtggaaaccgtcgtcgccggaccgttatgtgaatcgggcgatgtctttacccagcaggaagggggaaatgttgaaacccgcgccttgccggaagtgaaggcaggtgattatctggtactgcatgatacaggggcatatggcgcatcaatgtcatccaactacaatagccgtccgctgttaccagaagttctgtttgataatggtcaggcgcggttgattcgccgtcgccagaccatcgaagaattactggcgctggaattgctttaa

SEQ ID NO: 47223 - DNA, 1419 bp, Escherichia coli
atggttactatcaatacggaatctgctttaacgccacgttctttgcgggatacgcggcgtatgaatatgtttgtttcggtagctgctgcggtcgcaggattgttatttggtcttgatatcggcgtaatcgccggagcgttgccgttcattaccgatcactttgtgctgaccagtcgtttgcaggaatgggtggttagtagcatgatgctcggtgcagcaattggtgcgctgtttaatggttggctgtcgttccgcctggggcgtaaatacagcctgatggcgggggccatcctgtttgtactcggttctatagggtccgcttttgcgaccagcgtagagatgttaatcgccgctcgtgtggtgctgggcattgctgtcgggatcgcgtcttacaccgctcctctgtatctttctgaaatggcaagtgaaaacgttcgcggtaagatgatcagtatgtaccagttgatggtcacactcggcatcgtgctggcgtttttatccgatacagcgttcagttatagcggtaactggcgcgcaatgttgggggttcttgctttaccagcagttctgctgattattctggtagtcttcctgccaaatagcccgcgctggctggcggaaaaggggcgtcatattgaggcggaagaagtattgcgtatgctgcgcgatacgtcggaaaaagcgcgagaagaactcaacgaaattcgtgaaagcctgaagttaaaacagggcggttgggcactgtttaagatcaaccgtaacgtccgtcgtgctgtgtttctcggtatgttgttgcaggcgatgcagcagtttaccggtatgaacatcatcatgtactacgcgccgcgtatcttcaaaatggcgggctttacgaccacagaacaacagatgattgcgactctggtcgtagggctgacctttatgttcgccacctttattgcggtgtttacggtagataaagcagggcgtaaaccggctctgaaaattggtttcagcgtgatggcgttaggcactctggtgctgggctattgcctgatgcagtttgataacggtacggcttccagtggcttgtcctggctctctgttggcatgacgatgatgtgtattgccggttatgcgatgagcgccgcgccagtggtgtggatcctgtgctctgaaattcagccgctgaaatgccgcgatttcggtattacctgttcgaccaccacgaactgggtgtcgaatatgattatcggcgcgaccttcctgacactgcttgatagcattggcgctgccggtacgttctggctctacactgcgctgaacattgcgtttgtgggcattactttctggctcattccggaaaccaaaaatgtcacgctggaacatatcgaacgcaaactgatggcaggcgagaagttgagaaatatcggcgtctga

SEQ ID NO: 47224 - DNA, 762 bp, Escherichia coli
atgattttaagtgcattttctctcgaaggtaaagttgcggtcgtcactggttgtgatactggactgggtcaggggatggcgttggggctggcgcaagcgggctgtgacattgttggcattaacatcgttgaaccgactgaaaccatcgagcaggtcacagcgctggggcgtcgttttttaagcctgaccgccgatctgcgaaagattgatggtattccagcactgctggatcgcgcggtagcggagtttggtcatattgatatcctggtgaataacgccggattgattcgccgcgaagatgctctcgagttcagcgaaaaggactgggacgatgtcatgaacctgaatatcaagagcgtattcttcatgtctcaggcagcggcgaaacactttatcgcgcaaggcaatggcggcaagattatcaatatcgcgtcaatgctctccttccagggcgggatccgtgtgccttcttataccgcatcaaaaagcggcgtgatgggtgtgacgcgattgatggcgaacgaatgggctaaacacaacattaatgttaatgcgatagccccgggttacatggcgaccaacaatactcaacaactacgggcagatgaacaacgtagcgcggaaattctcgaccgcattccagctggtcgttggggactgccgagtgacctgatggggccgatagtgttccttgcctccagcgcttcagattatgtgaatggttataccattgccgtggatggcggttggctggcgcgttaa

SEQ ID NO: 47225 - DNA, 1185 bp, Escherichia coli
gtgatgaaagacgttgtgattgtcggggcgttacggacacctatcggctgctttcgtggtgcgttagcgggtcattccgccgtggaacttggtagtctggtcgtgaaagcgttaatagaacgtaccggcgttcctgcatatgcggtggatgaagtaattcttggtcaggtgttgactgcaggggcagggcagaatccggcaaggcaatcggctattaaaggtggtctgcctaatagcgtttctgcaatcactattaatgacgtttgcggttccgggcttaaagcactgcatctggctactcaggcgatacagtgtggcgaggctgatattgtcatcgccggtggccaggaaaacatgagccgcgcaccacatgttctgactgatagccgcaccggtgcacagcttggcaatagccagttggttgacagtcttgtgcatgatgggttgtgggatgccttcaatgattatcatattggtgtcaccgccgaaaatctggctcgcgaatatggcatcagccgtcagttgcaggatgcttacgcacttagctcgcaacaaaaagcgcgagcggcgattgacgccggacgatttaaagatgagatcgtcccggtaatgacccaaagtaacgggcagacgttggttgttgataccgatgaacagccacgcactgacgccagcgcagaaggcttagcccgtttaaatccttcatttgatagtctcggttctgtgacagcgggtaatgcatcatccataaacgatggcgcagctgcggtaatgatgatgagcgaagccaaagcacgagcgttgaatttacccgtgctggcccgcattcgcgcatttgccagcgttggtgtagatccggcattgatgggaattgcgccggtgtatgcgacccgccgttgcctggagcgtgtaggctggcagttggctgaagtcgatcttatcgaggctaatgaagcgtttgctgcacaggcgctttcggttggcaagatgcttgagtgggatgagcgtcgggtcaatgtcaatggtggcgcgatcgcactcggtcacccgataggcgcttccggttgccgaatcctggtttctctggttcatgaaatggtgaaacgtaatgcccgcaaaggactggcaacgctttgtatcggcgggggccagggtgtggcattgaccattgaacgtgacgaatag

SEQ ID NO: 47226 - DNA, 1092 bp, Escherichia coli
ttgttaacgtgggaacagacgccagatgaactgaaacaagtactggacgttgccgcagcattaaaagcactgcgtgctgaaaacatctcaaccaaagtctttaatagtggattaggtatttccgtattccgcgacaactccacccgtacccgcttctcttatgcttccgcgcttaacctgctcggccttgcacaacaagatctcgacgaaggcaaatcacaaatcgctcacggcgaaaccgtgcgtgaaaccgccaatatgatctccttctgcgccgacgctattggtattcgcgacgatatgtatctgggcgcaggcaacgcctatatgcgtgaagttggcgctgcacttgatgacggttacaagcagggtgtactgccacagcgtccggctttagtgaacctgcaatgcgatattgaccacccgactcagtcaatggctgacctcgcgtggttacgtgaacactttggttcactggaaaacctgaaaggtaaaaaaatcgccatgacctgggcctactctccaagctatggcaaaccgctctctgtaccacaaggcatcatcggtctgatgactcgcttcggtatggatgtcaccctggcccatccggaaggctacgacctgatcccggatgtggttgaagtggcgaaaaacaatgctaaagcctccggtggtagcttccgtcaggtcaccagcatggaagaagccttcaaagacgcagacatcgtttatccgaagtcatgggcaccttacaaagtgatggaagagcgtactgaattgctgcgtgcgaacgatcacgaaggcttaaaagcactggaaaaacagtgtctggcacagaacgcgcaacacaaagactggcattgtactgaagagatgatggaactgacccgtgatggcgaagccctgtacatgcactgcctgccagctgatatcagcggcgtatcctgtaaagaaggtgaagtgactgaaggcgtattcgaaaaataccgtatcgctacctacaaagaagccagctggaagccttatatcatcgccgcgatgatctgtcccgtaaatacgccaaaccaggtgcactgctcgagcaactgctga

SEQ ID NO: 47227 - DNA, 549 bp, Escherichia coli
atgcaaacggaacacgtcattttattgaatgcacagggagttcccacgggtacgctggaaaagtatgccgcacacacggcagacacccgcttacatctcgcgttctccagttggctgtttaatgccaaaggacaattattagttacccgccgcgcactgagcaaaaaagcatggcctggcgtgtggactaactcggtttgtgggcacccacaactgggagaaagcaacgaagacgcagtgatccgccgttgccgttatgagcttggcgtggaaattacgcctcctgaatctatctatcctgactttcgctaccgcgccaccgatccgagtggcattgtggaaaatgaagtgtgtccggtatttgccgcacgcaccactagtgcgttacagatcaatgatgatgaagtgatggattatcaatggtgtgatttagcagatgtattacacggtattgatgccacgccgtgggcgttcagtccgtggatggtgatgcaggcgacaaatcgcgaagccagaaaacgattatctgcatttacccagcttaaataa

SEQ ID NO: 47228 - DNA, 1440 bp, Escherichia coli
atgatagtgaaaaaactcaccttaccgaaagatttcttatggggcggcgcagttgccgctcatcaggtcgaaggcggctggaacaaaggcggaaaagggccgagcatttgtgacgttctgaccggtggcgcacacggcgtgccgcgcgaaatcaccaaagaagtcttgccaggaaaatactatccaaaccatgaagccgttgatttttatggtcactataaggaagacatcaagctatttgccgaaatgggcttcaaatgttttcgtacatccattgcctggacgcgcatttttccaaaaggcgatgaagctcagccaaacgaagaagggctgaagttctacgatgatatgttcgatgaactgctgaaatacaacatcgaaccggtgatcaccctctcccactttgaaatgccgctgcatctggtgcagcaatacggtagctggaccaaccgtaaagtggttgatttctttgtacgtttcgcggaagtggtatttgaacgctataagcacaaagtcaaatactggatgaccttcaacgaaattaacaaccagcgtaactggcgtgcaccgctgttcggttactgctgctccggcgtggtgtataccgagcatgaaaacccggaagagacgatgtatcaggtgctgcatcaccagtttgtcgccagcgccctggcggtgaaagctgcgcgtcgcattaacccggagatgaaagtcggctgtatgctggcgatggtgccgctctatccttactcctgtaacccggacgatgtgatgttcgctcaggagtcgatgcgcgaacgctacgtctttaccgatgtgcagctacgcggctattacccgtcctatgtgttgaacgagtgggagcgtcgcggatttaacatcaaaatggaagacggcgatctggatgtgctgcgtgaaggcacctgcgattatcttggtttcagctattacatgaccaatgcagtgaaggccgaaggcggcaccggcgatgcgatctctggttttgaaggcagcgtaccaaacccgtatgttaaagcatctgactggggctggcagattgatccagtaggtctgcgctatgcactttgcgaactgtatgagcgttatcagaggccgctgtttattgtcgaaaacggttttggcgcttacgacaaagtggaagaagatggcagcatcaacgacgactaccgcattgactacctgcgcgcccatatcgaagagatgaaaaaagcggtgacttacgatggcgtggatctgatgggctacacaccgtggggctgcatcgactgcgtgtcgttcaccaccgggcagtacagcaaacgctacggctttatctatgtgaataaacatgacgacggtactggcgatatgtcgcgttcacgtaagaagagctttaactggtacaaagaggtgattgccagcaacggcgagaagctttaa

SEQ ID NO: 47229 - DNA, 744 bp, Escherichia coli
atggctatagcacttgtgactggtggcagtcgcggcatcgggcgggcaactgcattactgttggcgcaagaagggtatacggtggcggttaattatcagcaaaacctccacgcggcgcaggaagtgatgaacttaataacgcaagccggtggcaaagcattcgtgctccaggcggatatcagcgacgaaaaccaggtcgttgcgatgtttacagcaatcgatcagcacgatgaaccgctagcagcgctggtcaataacgccgggatcttgtttacccagtgcaccgttgaaaaccttaccgcagagcgaatcaaccgagtactttccaccaacgtgacgggatattttctctgctgccgcgaggcggtaaaacgcatggcgcttaaaaatggtggcagtggcggcgctatcgtcaatgtctcttcggtggcctcacggttgggttcgccaggggaatatgttgattacgcggcatcgaaaggggcgattgatacgttaaccaccggactatcgctggaagtcgccgcgcaggggatccgcgttaactgcgtgcggccagggtttatttataccgaaatgcacgccagcggcggcgagcctggacgcgtcgatcgcgttaagtcgaacatccccatgcagcgtggtggacaggcagaagaggtcgcgcaggccattgtctggctactaagtgataaagcctcttacgtcacgggaagttttatcgatttggcgggcgggaaataa

SEQ ID NO: 47230 - DNA, 390 bp, Escherichia coli
atgagcaacgtaccagcagaactgaaatacagcaaagaacacgaatggctgcgtaaagaagccgacggcacttacaccgttggtattaccgaacatgctcaggagctgttaggcgatatggtgtttgttgacctgccggaagtgggcgcaacggttagcgcgggcgatgactgcgcggttgccgaatcggtaaaagcggcgtcagacatttatgcgccagtaagcggtgaaatcgtggcggtaaacgacgcactgagcgattccccggaactggtgaacagcgaaccgtatgcaggcggctggatctttaaaatcaaagccagcgatgaaagcgaactggaatcactgctggatgcgaccgcatacgaagcattgttagaagacgagtaa

SEQ ID NO: 47231 - DNA, 1326 bp, Escherichia coli
atgagtgagatatcccggcaagagtttcagcgtcgccgtcaggccctggtggagcaaatgcaacccggcagcgccgcgctgatttttgctgcaccagaagtaacacgtagcgccgacagcgaatacccctatcgtcagaacagtgacttctggtacttcaccggctttaacgaaccggaagcggtgctggtgctgattaaaagcgatgacactcataaccacagcgttctgtttaaccgcgttcgcgacctgacggcggagatctggtttggccgtcgcttaggccaggatgccgcgccagagaaactgggcgttgaccgcgcactggcattcagcgaaatcaatcagcaactttatcaactacttaacggcctggatgtggtttaccatgcccagggcgaatatgcatatgctgatgtaatcgtgaacagtgcgctggaaaaactgcgtaaaggttcgcggcaaaatctcaccgcaccggcaacgatgatcgactggcgtcctgttgttcatgaaatgcgcctgttcaaatcgccagaagagattgccgtactccgccgcgcgggagaaatcaccgccatggcacatacacgggcgatggaaaaatgccgtccgggaatgttcgagtaccatctggaaggcgaaattcaccacgaatttaaccgccacggtgcgcgctatccgtcctataacaccattgtcggcagcggtgaaaacggctgcattctgcactacaccgaaaacgagtgtgaaatgcgcgacggcgacctggtgttgattgacgcgggttgtgaatacaaaggttacgctggcgatattacccgcaccttcccggtcaacggcaaattcacccaggcccagcgtgaaatctacgacattgtgctggagtctctcgaaaccagcctgcgcctgtatcgtccgggaacttccattctggaagtcactggtgaagtggtgcgcatcatggttagcggcctggtaaaactcggcatcctgaaaggtgatgttgatgaactgatcgctcagaacgcccatcgtcctttctttatgcatggccttagccactggttaggactggatgtccatgacgtgggtgtttatggtcaggatcgctcgcgcattctggaaccgggcatggtactgaccgtagagccagggctgtatattgcgccggatgcagaagtgccagaacaatatcgcggtatcggcattcgtattgaagacgacattgtgattaccgaaaccggtaacgaaaacctcaccgccagcgtggtgaaaaagccggaagaaatcgaagcgttgatggttgctgcgagaaagcaatga

SEQ ID NO: 47232 - DNA, 1080 bp, Escherichia coli
atgtctaagatttttgatttcgtaaaacctggcgtaatcactggtgatgacgtacagaaagttttccaggtagcaaaagaaaacaacttcgcactgccagcagtaaactgcgtcggtactgactccatcaacgccgtactggaaaccgctgctaaagttaaagcgccggttatcgttcagttctccaacggtggtgcttcctttatcgctggtaaaggcgtgaaatctgacgttccgcagggtgctgctatcctgggcgcgatctctggtgcgcatcacgttcaccagatggctgaacattatggtgttccggttatcctgcacactgaccactgcgcgaagaaactgctgccgtggatcgacggtctgttggacgcgggtgaaaaacacttcgcagctaccggtaagccgctgttctcttctcacatgatcgacctgtctgaagaatctctgcaagagaacatcgaaatctgctctaaatacctggagcgcatgtccaaaatcggcatgactctggaaatcgaactgggttgcaccggtggtgaagaagacggcgtggacaacagccacatggacgcttctgcactgtacacccagccggaagacgttgattacgcatacaccgaactgagcaaaatcagcccgcgtttcaccatcgcagcgtccttcggtaacgtacacggtgtttacaagccgggtaacgtggttctgactccgaccatcctgcgtgattctcaggaatatgtttccaagaaacacaacctgccgcacaacagcctgaacttcgtattccacggtggttccggttctactgctcaggaaatcaaagactccgtaagctacggcgtagtaaaaatgaacatcgataccgatacccaatgggcaacctgggaaggcgttctgaactactacaaagcgaacgaagcttatctgcagggtcagctgggtaacccgaaaggcgaagatcagccgaacaagaaatactacgatccgcgcgtatggctgcgtgccggtcagacttcgatgatcgctcgtctggagaaagcattccaggaactgaacgcgatcgacgttctgtaa

SEQ ID NO: 47233 - DNA, 1164 bp, Escherichia coli
atgtctgtaattaagatgaccgatctggatcttgctgggaaacgtgtatttatccgtgcggatctgaacgtaccagtaaaagacgggaaagtaaccagcgacgcgcgtatccgtgcttctctgccgaccatcgaactggccctgaaacaaggcgcaaaagtgatggtaacttcccacctgggtcgtcctaccgaaggcgagtacaacgaagaattctctctgctgccggttgttaactacctgaaagacaaactgtctaacccggttcgtctggttaaagattacctcgacggcgttgacgttgctgaaggtgaactggttgttctggaaaacgttcgcttcaacaaaggcgagaagaaagacgacgaaaccctgtccaaaaaatacgctgcactgtgtgacgtgttcgtaatggacgcattcggtactgctcaccgcgcgcaggcttctactcacggtatcggtaaattcgctgacgttgcgtgcgcaggcccgctgctggcagctgaactggacgcgctgggtaaagcactgaaagaacctgctcgcccgatggtggctatcgttggtggttctaaagtatctaccaaactgaccgttctggactccctgtctaaaatcgctgaccagctgattgttggtggtggtatcgctaacacctttatcgcggcacaaggccacgatgtgggtaaatccctgtacgaagctgacctggttgacgaagctaaacgtctgctgaccacctgcaacatcccggttccgtctgatgttcgcgtagcaaccgagttctctgaaactgcaccggctaccctgaaatctgttaacgatgtgaaagctgacgagcagatcctggatatcggtgatgcttccgctcaggaactggctgaaatcctgaagaatgcgaaaaccattctgtggaacggtccggttggcgtgttcgaattcccgaacttccgcaaaggtactgaaatcgtggctaacgctatcgcagacagcgaagcgttctccatcgctggcggcggcgacactctggcagcaatcgacctgttcggcattgctgacaaaatctcctacatctccactggcggcggcgcattcctcgaattcgtggaaggtaaagtactgcctgcagtagcgatgctcgaagagcgcgctaagaagtaa

SEQ ID NO: 47234 - DNA, 1020 bp, Escherichia coli
atgaccgtacgcgtagcgataaatggcttcggtcgcatcgggcgtaatgtggttcgtgctttgtatgaatccggacgccgggcggaaattaccgtggtggcaatcaacgaactggcggatgctgcgggcatggcgcatttgttgaaatatgacaccagccatggccgttttgcatgggaagtacgacaggaacgcgatcaactttttgttggtgatgacgccatccgcgtattgcatgaacgttcactgcaatcgctcccctggcgtgaacttggcgttgatgtagtcctcgactgcaccggcgtatatggctcccgcgagcatggcgaagcgcatattgccgccggggccaaaaaagtgctcttttcacatcctggcagtaacgatctcgacgcgaccgttgtttacggcgtcaatcaggatcaacttcgtgcggaacaccgcatcgtttctaacgcttcctgtaccacgaattgcataattcccgtcatcaaattgttagatgatgcgtacggtattgagtccggcactgtgaccacaattcactccgccatgcacgatcaacaggttattgatgcataccatcctgacctgcgtcgcacccgggcagccagccagtcgatcattccggtcgatactaaactggccgccggtatcacacgattttttccgcaatttaacgatcgctttgaagcgattgcggtacgtgtgccaaccataaatgtgacggcaatcgatttaagcgtgacggtgaagaaacctgtaaaagccaatgaagtcaacctgttgctgcaaaaagcagcacaaggtgcatttcatggtatagttgactatacggaattgccgttggtctctgtagattttaaccacgatccgcacagtgccattgtcgatggcacccaaacccgggtcagtggcgcacacctgatcaaaacgttggtctggtgcgataacgaatggggctttgctaaccgaatgctcgacacgacgttagctatggctactgttgctttcaggtaa

SEQ ID NO: 47235 - DNA, 1992 bp, Escherichia coli
atgtcctcacgtaaagagcttgccaatgctattcgtgcgctgagcatggacgcagtacagaaagccaaatccggtcacccgggtgcccctatgggtatggctgacattgccgaagtcctgtggcgtgatttcctgaaacacaacccgcagaatccgtcctgggctgaccgtgaccgcttcgtgctgtccaacggccacggctccatgctgatctacagcctgctgcacctcaccggttacgatctgccgatggaagaactgaaaaacttccgtcagctgcactctaaaactccgggtcacccggaagtgggttacaccgctggtgtggaaaccaccaccggtccgctgggtcagggtattgccaacgcagtcggtatggcgattgcagaaaaaacgctggcggcgcagtttaaccgtccgggccacgacattgtcgaccactacacctacgccttcatgggcgacggctgcatgatggaaggcatctcccacgaagtttgctctctggcgggtacgctgaagctgggtaaactgattgcattctacgatgacaacggtatttctatcgatggtcacgttgaaggctggttcaccgacgacaccgcaatgcgtttcgaagcttacggctggcacgttattcgcgacatcgacggtcatgacgcggcatctatcaaacgcgcagtagaagaagcgcgcgcagtgactgacaaaccttccctgctgatgtgcaaaaccatcatcggtttcggttccccgaacaaagccggtacccacgactcccacggtgcgccgctgggcgacgctgaaattgccctgacccgcgaacaactgggctggaaatatgcgccgttcgaaatcccgtctgaaatctatgctcagtgggatgcgaaagaagcaggccaggcgaaagaatccgcatggaacgagaaattcgctgcttacgcgaaagcttatccgcaggaagccgctgaatttacccgccgtatgaaaggcgaaatgccgtctgacttcgacgctaaagcgaaagagttcatcgctaaactgcaggctaatccggcgaaaatcgccagccgtaaagcgtctcagaatgctatcgaagcgttcggtccgctgttgccggaattcctcggcggttctgctgacctggcgccgtctaacctgaccctgtggtctggttctaaagcaatcaacgaagatgctgcgggtaactacatccactacggtgttcgcgagttcggtatgaccgcgattgctaacggtatctccctgcacggtggcttcctgccgtacacctccaccttcctgatgttcgtggaatacgcacgtaacgccgtacgtatggctgcgctgatgaaacagcgtcaggtgatggtttacacccacgactccatcggtctgggcgaagacgggccgactcaccagccggttgagcaggtcgcttctctgcgcgtaaccccgaacatgtctacatggcgtccgtgtgaccaggttgaatccgcggtcgcgtggaaatacggtgttgagcgtcaggacggcccgaccgcactgatcctctcccgtcagaacctggcgcagcaggaacgaactgaagagcaactggcaaacatcgcgcgcggtggttatgtgctgaaagactgcgccggtcagccggaactgattttcatcgctaccggttcagaagttgaactggctgttgctgcctacgaaaaactgactgccgaaggcgtgaaagcgcgcgtggtgtccatgtcgtctaccgacgcatttgacaagcaggatgctgcttaccgtgaatccgtactgccgaaagcggttactgcacgcgttgctgtagaagcgggtattgctgactactggtacaagtatgttggcctgaacggtgctatcgtcggtatgaccaccttcggtgaatctgctccggcagagctgctgtttgaagagttcggcttcactgttgataacgttgttgcgaaagcaaaagaactgctgtaa

SEQ ID NO: 47236 - DNA, 921 bp, Escherichia coli
atgagcaccttaggtcatcaatacgataactcactggtttccaatgcctttggttttttacgcctgccgatgaacttccagccgtatgacagcgatgcagactgggtgattactggcgtgccgttcgatatggccacttctggtcgtgcgggtggtcgccacggtccggcagcgatccgtcaggtttcgacgaatctggcctgggaacacaaccgcttcccgtggaatttcgacatgcgtgagcgtctgaacgtcgtggactgcggcgatctggtatatgcctttggcgatgcccgtgagatgagcgaaaagctgcaggcgcacgccgagaagctgctggctgccggtaagcgtatgctctctttcggtggtgaccactttgttacgctgccgctgctgcgtgctcatgcgaagcatttcggcaaaatggcgctggtacactttgacgcccacaccgatacctatgcgaacggttgtgaatttgaccacggcactatgttctataccgcgccgaaagaaggtctgatcgacccgaatcattccgtgcagattggtattcgtaccgagtttgataaagacaacggctttaccgtgctggacgcctgccaggtgaacgatcgcagcgtggatgacgttatcgcccaagtgaaacagattgtgggtgatatgccggtttacctgacttttgatatcgactgcctggatcctgcttttgcaccaggcaccggtacgccagtgattggcggcctgacctccgatcgcgctattaaactggtacgcggcctgaaagatctcaacattgttgggatggacgtagtggaagtggctccggcatacgatcagtcggaaatcactgctctggcagcggcaacgctggcgctggaaatgctgtatattcaggcggcgaaaaagggcgagtaa

SEQ ID NO: 47237 - DNA, 1977 bp, Escherichia coli
atgtctgacgacatgtctatgggtttgccttcgtcagcgggcgaacacggtgtactacgctccatgcaggaggttgcaatgagctcccaggaagccagcaagatgctgcgtacttacaatattgcctggtggggcaataactactatgacgttaacgagctgggccacattagcgtgtgcccggacccggacgtcccggaagctcgcgtcgatctcgcgcagttagtgaaaactcgtgaagcacagggccagcgtctgcctgcactgttctgtttcccacagatcctgcagcaccgtttgcgttccattaacgccgcgttcaaacgtgcgagggaatcctacggctataacggcgattacttccttgtttatccgatcaaagttaaccagcaccgccgcgtgattgagtccctgattcattcgggcgaaccgctgggtctggaagccggttccaaagccgagttgatggcagtactggcacatgctggcatgacccgtagcgtcatcgtctgcaacggttataaagaccgcgaatatatccgcctggcattaattggcgagaagatggggcacaaggtctatctggtcattgagaagatgtcagaaatcgccattgtgctggatgaagcagaacgtctgaatgtcgttcctcgtctgggcgtgcgtgcacgtctggcttcgcagggttcgggtaaatggcagtcctccggcggggaaaaatcgaagttcggcctggctgcgactcaggtactgcaactggttgaaaccctgcgtgaagccgggcgtctcgacagcctgcaactactgcacttccacctcggttcgcagatggcgaatattcgcgatatcgcgacaggcgttcgtgaatccgcgcgtttctatgtggaactgcacaagctgggcgtcaatattcagtgcttcgacgtcggcggcggtctgggcgtggattatgaaggtactcgttcgcagtccgactgttcggtgaactacggcctcaatgaatacgccaacaacattatctgggcgattggcgatgcgtgtgaagaaaacggtctgccgcatccgacggtaatcaccgaatcgggtcgtgcggtgactgcgcatcacaccgtgctggtgtctaatatcatcggcgtggaacgtaacgaatacacggtgccgaccgcgcctgcagaagatgcgccgcgcgcgctgcaaagcatgtgggaaacctggcaggagatgcacgaaccgggaactcgccgttctctgcgtgaatggttacacgacagtcagatggatctgcacgacattcatatcggctactcttccggcatctttagcctgcaagaacgtgcatgggctgagcagctttatttgagcatgtgccatgaagtgcaaaagcagctggatccgcaaaaccgtgctcatcgtccgattatcgacgagctgcaggaacgtatggcggacaaaatgtacgtcaacttctcgctgttccagtcgatgccggacgcatgggggatcgaccagttgttcccggttctgccgctggaagggctggatcaagtgccggaacgtcgcgctgtgctgctggatattacctgtgactctgacggtgctatcgaccactatattgatggtgacggtattgccacgacaatgccaatgccggagtacgatccagagaatccgccgatgctcggtttctttatggtcggcgcatatcaggagatcctcggcaacatgcacaacctgttcggtgataccgaagcggttgacgtgttcgtcttccctgacggtagcgtagaagtagaactgtctgacgaaggcgataccgtggcggacatgctgcaatatgtacagctcgatccgaaaacgctgttaacccagttccgcgatcaagtgaagaaaaccgatcttgatgctgaactgcaacaacagttccttgaagagttcgaggcaggtttgtacggttatacttatcttgaagatgagtaa

SEQ ID NO: 47238 - DNA, 1155 bp, Escherichia coli
atggcaaaacacctttttacgtccgagtccgtctctgaagggcatcctgacaaaattgctgaccaaatttctgatgccgttttagacgcgatcctcgaacaggatccgaaagcacgcgttgcttgcgaaacctacgtaaaaaccggcatggttttagttggcggcgaaatcaccaccagcgcctgggtagacatcgaagagatcacccgtaacaccgttcgcgaaattggctatgtgcattccgacatgggctttgacgctaactcctgtgcggttctgagcgctatcggcaaacagtctcctgacatcaaccagggcgttgaccgtgccgatccgctggaacagggcgcgggtgaccagggtctgatgtttggctacgcaactaatgaaaccgacgtgctgatgccagcacctatcacctatgcacaccgtctggtacagcgtcaggctgaagtgcgtaaaaacggcactctgccgtggctgcgcccggacgcgaaaagccaggtgacttttcagtatgacgacggcaaaatcgttggtatcgatgctgtcgtgctttccactcagcactctgaagagatcgaccagaaatcgctgcaagaagcggtaatggaagagatcatcaagccaattctgcccgctgaatggctgacttctgccaccaaattcttcatcaacccgaccggtcgtttcgttatcggtggcccaatgggtgactgcggtctgactggtcgtaaaattatcgttgatacctacggcggcatggcgcgtcacggtggcggtgcattctctggtaaagatccatcaaaagtggaccgttccgcagcctacgcagcacgttatgtcgcgaaaaacatcgttgctgctggcctggccgatcgttgtgaaattcaggtttcctacgcaatcggcgtggctgaaccgacctccatcatggtagaaactttcggtactgagaaagtgccttctgaacaactgaccctgctggtacgtgagttcttcgacctgcgcccatacggtctgattcagatgctggatctgctgcacccgatctacaaagaaaccgcagcatacggtcactttggtcgtgaacatttcccgtgggaaaaaaccgacaaagcgcagctgctgcgcgatgctgccggtctgaagtaa

SEQ ID NO: 47239 - DNA, 1395 bp, Escherichia coli
atgcctgacgctaaaaaacaggggcggtcaaacaaggcaatgacgtttttcgtctgcttccttgccgctctggcgggattactctttggcctggatatcggtgtaattgctggcgcactgccgtttattgcagatgaattccagattacttcgcacacgcaagaatgggtcgtaagctccatgatgttcggtgcggcagtcggtgcggtgggcagcggctggctctcctttaaactcgggcgcaaaaagagcctgatgatcggcgcaattttgtttgttgccggttcgctgttctctgcggctgcgccaaacgttgaagtactgattctttcccgcgttctactggggctggcggtgggtgtggcctcttataccgcaccgctgtacctctctgaaattgcgccggaaaaaattcgtggcagtatgatctcgatgtatcagttgatgatcactatcgggatcctcggtgcttatctttctgataccgccttcagctacaccggtgcatggcgctggatgctgggtgtgattatcatcccggcaattttgctgctgattggtgtcttcttcctgccagacagcccacgttggtttgccgccaaacgccgttttgttgatgccgaacgcgtgctgctacgcctgcgtgacaccagcgcggaagcgaaacgcgaactggatgaaatccgtgaaagtttgcaggttaaacagagtggctgggcgctgtttaaagagaacagcaacttccgccgcgcggtgttccttggcgtactgttgcaggtaatgcagcaattcaccgggatgaacgtcatcatgtattacgcgccgaaaatcttcgaactggcgggttataccaacactaccgagcaaatgtgggggaccgtgattgtcggcctgaccaacgtacttgccacctttatcgcaatcggccttgttgaccgctggggacgtaaaccaacgctaacgctgggcttcctggtgatggctgctggcatgggcgtactcggtacaatgatgcatatcggtattcactctccgtcggcgcagtatttcgccatcgccatgctgctgatgtttattgtcggttttgccatgagtgccggtccgctgatttgggtactgtgctccgaaattcagccgctgaaaggccgcgattttggcatcacctgctccactgccaccaactggattgccaacatgatcgttggcgcaacgttcctgaccatgctcaacacgctgggtaacgccaacaccttctgggtgtatgcggctctgaacgtactgtttatcctgctgacattgtggctggtaccggaaaccaaacacgtttcgctggaacatattgaacgtaatctgatgaaaggtcgtaaactgcgcgaaataggcgctcacgattaa

SEQ ID NO: 47240 - DNA, 2196 bp, Escherichia coli
atggggcagggttttccaccttgtccggtattcttacttccccgaaacgggtttgcgcttatgaaatcaatgaatattgccgccagtagtgaactggtatcccgactttcttctcatcgtcgcgtggtggcgttgggagatactgattttacggacgtcgcggcagtcgtcattaccgctgcggatagtcgcagtggcattcttgcgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggcaacagcacctttgcttgccctggacatcaacatggtgcgttttttaaaaagcatcctgccggacgccatttttacgatttctttggtgagaacgtctttcgcgccgatatgtgtaacgctgacgtaaaattgggcgatctgcttattcatgaaggatcggcgaaagatgcgcagaaattcgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcacggcgcgctgattcaggcgggggcgacgccggtctatctggaagcttcacgcaacccgtttggtttcattggcggtattgatgcgcactgttttaatgaagagtatctgcgccagcaaattcgcgacgttgcgccagaaaaagccgacctgccgcgcccgtatcgcctggcgattattcagctgggaacctatgacggcactgtctataacgcccgtcaggtgatcgataccgttgggcatctgtgtgattacattctgtttgattccgcgtgggtcggttatgaacaatttatcccgatgatggcggatagctcgccgctgctgttagaacttaacgaaaacgatccggggatctttgtgactcagtcggtgcacaaacagcaggcgggattctcacagacgtcgcagatccataaaaaagataaccatatccgcggacaggcgcgtttttgcccgcataagcggttgaataacgcctttatgctccatgcttctaccagccctttctatccgctgtttgctgcactggatgttaacgccaaaattcatgaaggggagagtgggcgtcggctgtgggctgagtgtgttgagatagggattgaagcgcgcaaggctattcttgcgcgctgtaagctgttccgcccgtttatcccgcccgttgttgatggcaaattgtggcaggattatccgacatcagtgttagccagcgaccgccgttttttcagttttgagccgggggcgaagtggcacggctttgaaggatatgccgcggatcagtattttgttgatccgtgcaagctgttactcactacaccaggtatcgatgccgaaaccggcgaatatagcgactttggcgttccggcgacgattctggcgcactatctgcgtgagaacggcattgtgccggagaagtgcgatctcaactccattctgtttttattaactccggcggaaagccacgagaagctggcacaactggtggcgatgctggcgcaatttgaacagcatattgaggatgactcgccgctggttgaggtgttgccgagcgtttataacaagtatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaacccccaggatgcgcatagcgcttatattcgcggtgacgtggagttggtgcggattcgtgatgccgaagggcgaattgcggcagaaggggcgttgccttatccacctggcgtgctttgcgtggtacccggggaagtctggggtggggcggttcaacgttatttccttgcactggaagaaggggtgaatttgttgccgggattttcgccggagctgcaaggtgtttatagcgaaaccgatgcggatggcgtgaaacggttgtacggttatgtgttgaagtaa

SEQ ID NO: 47241 - DNA, 1500 bp, Escherichia coli
atgagcatcttgtacgaagagcgtcttgatggcgctttacccgatgtcgaccgcacatcggtactgatggcactgcgtgagcatgtccctggacttgagatcctgcataccgatgaggagatcattccttacgagtgtgacgggttgagcgcgtatcgcacgcgtccattactggttgttctgcctaagcaaatggaacaggtgacagcgattctggctgtctgccatcgcctgcgtgtaccggtggtgacccgtggtgcaggcaccgggctttctggtggcgcgctgccgctggaaaaaggtgtgttgttggtgatggcgcgctttaaagagatcctcgacattaaccccgttggtcgccgcgcgcgcgtgcagccaggcgtgcgtaacctggcgatctcccaggccgttgcaccgcataatctctactacgcaccggacccttcctcacaaatcgcctgttccattggcggcaatgtggctgaaaatgccggcggcgtccactgcctgaaatatggtctgaccgtacataacctgctgaaaattgaagtgcaaacgctggacggcgaggcactgacgcttggatcggacgcgctggattcacctggttttgacctgctggcgctgttcaccggatcggaaggtatgctcggcgtgaccaccgaagtgacggtaaaactgctgccgaagccgcccgtggcgcgggttctgttagccagctttgactcggtagaaaaagccggacttgcggttggtgacatcatcgccaatggcattatccccggcgggctggagatgatggataacctgtcgatccgcgcggcggaagattttattcatgccggttatcccgtcgacgccgaagcgattttgttatgcgagctggacggcgtggagtctgacgtacaggaagactgcgagcgggttaacgacatcttgttgaaagcgggcgcgactgacgtccgtctggcacaggacgaagcagagcgcgtacgtttctgggccggtcgcaaaaatgcgttcccggcggtaggacgtatctccccggattactactgcatggatggcaccatcccgcgtcgcgccctgcctggcgtactggaaggcattgcccgtttatcgcagcaatatgatttacgtgttgccaacgtctttcatgccggagatggcaacatgcacccgttaatccttttcgatgccaacgaacccggtgaatttgcccgcgcggaagagctgggcgggaagatcctcgaactctgcgttgaagttggcggcagcatcagtggcgaacatggcatcgggcgagaaaaaatcaatcaaatgtgcgcccagttcaacagcgatgaaatcacgaccttccatgcggtcaaggcggcgtttgaccccgatggtttgctgaaccctgggaaaaacattcccacgctacaccgctgtgctgaatttggtgccatgcatgtgcatcacggtcatttacctttccctgaactggagcgtttctga

SEQ ID NO: 47242 - DNA, 885 bp, Escherichia coli
atgtctcatttaaaagacccgaccacgcagtattacactggtgaatatcccaaacagaaacaaccgacgccaggcatccaggcgaagatgacaccggtaccggattgcggcgagaaaacctatgttggtagcggtcgcctgaaagatcgtaaagcactggtgacagggggcgattccggaataggtcgcgctgccgccatcgcttacgcgcgtgaaggggctgacgtggcgatcagttatcttcccgtggaagaagaagacgctcaggatgtgaaaaagatcattgaagaatgcggacgcaaagccgttctgctgccaggcgatttaagcgatgagaaatttgcccgttcgctggttcacgaagcgcacaaggcgttaggcgggctggatattatggcgctggtcgccgggaaacaggttgccattccggatattgcagacctcaccagcgaacagtttcaaaagacctttgccattaacgttttcgcgctgttctggctaacccaggaagcgatccccctgctaccgaaaggtgcaagtatcatcaccacttcgtcaatccaggcataccagccaagtccgcatttactggactatgcggctacgaaggcggcgattctgaactacagccgtggcttggcaaaacaggtcgcggagaaaggtattcgggtgaatattgtcgcgccaggcccgatctggacagcactgcaaatttccggcggacaaacgcaggataagatcccgcagtttggtcagcaaacgccgatgaaacgtgcggggcaaccggcggaactggcccctgtatatgtttatctggcaagtcaggagtcgagctacgtcaccgcagaagtgcacggcgtgtgcggcggcgagcatttaggttaa

SEQ ID NO: 47243 - DNA, 1188 bp, Escherichia coli
atggcggacaaaaagcttgatactcaactggtgaatgcaggacgcagcaaaaaatacactctcggcgcggtaaatagcgtgattcagcgcgcttcttcgctggtctttgacagtgtagaagccaaaaaacacgcgacacgtaatcgcgccaatggagagttgttctatggacggcgcggaacgttaacccatttctccttacaacaagcgatgtgtgaactggaaggtggcgcaggctgcgtgctatttccctgcggggcggcagcggttgctaattccattcttgcttttatcgaacagggcgatcatgtgttgatgaccaacaccgcctatgaaccgagtcaggatttctgtagcaaaatcctcagcaaactgggcgtaacgacatcatggtttgatccgctgattggtgccgatatcgttaagcatctgcagccaaacactaaaatcgtgtttctggaatcgccaggctccatcaccatggaagtccacgacgttccggcgattgttgccgccgtacgcagtgtggtgccggatgccatcattatgatcgacaacacctgggcagccggtgtgctgtttaaggcgctggattttggcatcgatgtttctattcaagccgccaccaaatatctggttgggcattcagatgcgatgattggcactgccgtgtgcaatgcccgttgctgggagcagctacgggaaaatgcctatctgatgggccagatggtcgatgccgataccgcctatataaccagccgtggcctgcgcacattaggtgtgcgtttgcgtcaacatcatgaaagcagtctgaaagtggctgaatggctggcagaacatccgcaagttgcgcgagttaaccaccctgctctgcctggcagtaaaggtcacgaattctggaaacgagactttacaggcagcagcgggctattttcctttgtgcttaagaaaaaactcaataatgaagagctggcgaactatctggataacttcagtttattcagcatggcctactcgtggggcgggtatgaatcgttgatcctggcaaatcaaccagaacatatcgccgccattcgcccacaaggcgagatcgattttagcgggaccttgattcgcctgcatattggtctggaagatgtcgacgatctgattgccgatctggacgccggttttgcgcgaattgtataa

SEQ ID NO: 47244 - DNA, 1164 bp, Escherichia coli
atgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgagccaaacccggcttatgaaacgctgatgaacgccgtgaaactggttcgcgaacagaaagtgactttcctgctggcggttggcggcggttctgtactggacggcaccaaatttatcgccgcagcggctaactatccggaaaatatcgatccgtggcacattctgcaaacgggcggtaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagccggtatttgccgtgctcgatccggtttatacctacaccctgccgccgcgtcaggtggctaacggcgtagtggacgcctttgtacacaccgtggaacagtatgttaccaaaccggttgatgccaaaattcaggaccgtttcgcagaaggcattttgctgacgctaatcgaagatggtccgaaagccctgaaagagccagaaaactacgatgtgcgcgccaacgtcatgtgggcggcgactcaggcgctgaacggtttgattggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttccgatgatgagcgtattgacgccgcgattgccgcaacccgcaatttctttgagcaattaggcgtgccgacccacctctccgactacggtctggacggcagctccatcccggctttgctgaaaaaactggaagagcacggcatgacccaactgggcgaaaatcatgacattacgttggatgtcagccgccgtatatacgaagccgcccgctaa

SEQ ID NO: 47245 - DNA, 711 bp, Escherichia coli
gtgggttatcgctcgattgataccgccgcggcctacaagaacgaagaaggtgtcggcaaagccctgaaaaatgcctcagtcaacagagaagaactgttcatcaccactaagctgtggaacgacgaccacaagcgcccccgcgaagccctgctcgacagcctgaaaaaactccagcttgattatatcgacctctacttaatgcactggcccgttcccgctatcgaccattatgtcgaagcatggaaaggcatgatcgaattgcaaaaagagggattaatcaaaagcatcggcgtgtgcaacttccagatccatcacctgcaacgcctgattgatgaaactggcgtgacgcctgtgataaaccagatcgaacttcatccgctgatgcaacaacgccagctacacgcctggaacgcgacacacaaaatccagaccgaatcctggagcccattagcgcaaggagggaaaggcgttttcgatcagaaagtcattcgcgatctggcagataaatacggcaaaaccccggcgcagattgttatccgctggcatctggatagcggcctggtggtgatcccgaaatcggtcacaccttcacgtattgccgaaaactttgatgtctgggatttccgtctcgacaaagacgaactcggcgaaattgcaaaactcgatcagggcaagcgtctcggtcccgatcctgaccagttcggcggctaa

SEQ ID NO: 47246 - DNA, 1464 bp, Escherichia coli
atgaaaccttccactgaatggtggcgatatcttgcgccgctggcggtcatcgccattattgctctacttccggttcccgcagggctggagaaccatacctggctctactttgccgtttttactggcgtgatcgttggactgatcctcgaacccgtgccgggtgccgtggtggcgatggtgggtatatccatcatcgccatactctctccctggctgctgttcagcccggagcagctcgctcagccaggctttaaattcactgcaaaatccctctcgtgggccgtttccggtttttctaattcggttatctggctgattttcgccgcctttatgtttggcacaggctatgaaaaaaccgggcttggacgccgcattgcgctgattctggtgaaaaagatgggacatcgcacgctgtttctcggctatgcggtgatgttctccgagctgatcctcgcacctgtaacaccgtccaactcggcgcgtggtgcggggattatctatcccatcatccgtaacctgccaccgctctatcaatcacaaccaaacgacagcagttcgcgcagcattggctcgtacatcatgtggatggggattgttgccgactgcgtgaccagcgccattttcttgacggcgatggcaccaaacttgctgttaattggactgatgaaaagcgcatctcacgccacgctgagttggggcgactggttcctcgggatgttgccgctcagcattttactggttctgctggttccctggctggcttacgtgctgtacccgccggtactgaagtctggcgatcaggtgccgcgctgggcagagacggaactgcaggcaatgggcccgctctgttcgcgtgaaaaacggatgctggggctgatggtaggcgcgctggtgctgtggattttcggcggtgattatatcgatgccgcgatggtcggttacagcgtggtggcactgatgctgcttctgcgcattatcagttgggacgacattgtcagtaataaagcggcgtggaacgttttcttctggctggcctcgcttatcaccctcgccaccggactcaacaacaccggttttattagctggtttggcaaactgttagcaggcagcttaagcggttattcgccaacgatggtgatggtggcgttgattgtggtgttttatctactgcgctactttttcgccagcgccacggcgtatacctccgctctcgcaccgatgatgattgctgctgcgctggcgatgccggaaatcccgctgccggtgttctgcctgatggttggtgcggcaattggtctggggagcattcttacaccatacgccaccggccccagtccgatttactacggcagtggttatctgccaacggcggattactggcgactgggggcgatttttgggctgatattcctcgtattgctggtgattaccggcttactgtggatgcccgtggtgttgctttaa

SEQ ID NO: 47247 - DNA, 1491 bp, Escherichia coli
atgataaccgaatttgtgtttatcccgattttcgcgatcgcagccggagtggcgcaatccctgcaatacttaaatcggtatcatgtgatacgcgagcctccggagcatattttgaacaggttaccttcgagcgcatcggctttagcgtgcagcgcccacgccctgaatctcattgagaagcgaacgctggatcatgaggagatgaaagcacttaaccgagaggtgattgaatacttcaaagagcatgtcaatccggggtttttagagtatcgcaaatctgttaccgccggcggggattacggagccgtagagtggcaagcgggaagtttaaatacgcttgtcgacacccagggccaggagtttatcgactgcctgggaggttttggaattttcaacgtggggcaccgtaatccagttgtggtttccgccgtacagaatcaacttgcgaaacaaccgctgcacagccaggagctgctcgatccgttacgggcgatgttggcgaaaacccttgctgcgctaacgcccggtaaactgaaatacagcttcttctgtaatagcggcaccgagtccgttgaagcagcgctgaagctggcgaaagcttaccagtcaccgcgcggcaagtttacttttattgccaccagcggcgcgttccacggtaaatcacttggcgcgctgtcggccacggcgaaatcgaccttccgcaaaccgtttatgccgttactgccgggcttccgtcatgtgccgtttggcaatatcgaagccatgcgcacggctcttaacgagtgcaaaaaaaccggtgatgatgtggctgcggtgatcctcgaaccgattcagggtgaaggtggcgtaattctgccgccgccgggctatctcaccgccgtacgtaagctatgcgatgagttcggcgcactgatgatcctcgatgaagtacaaacgggcatggggcgcacgggcaagatgttcgcctgcgagcatgagaacgtacagccggatatcctctgccttgccaaagcgctcggcggcggcgtgatgccgattggcgcgaccatcgccactgaagaggtgttttcagttctgttcgacaacccattcctgcataccaccacctttggcggcaacccgctggcctgtgcggcggcgctggcgaccatcaatgtgttgctggagcagaacttaccggctcaggctgagcaaaaaggcgatatgttgctggacggtttccgtcaactggcgcgggaatatcccgatctggtacaggaagcgcgtggtaaagggatgttgatggcgattgagtttgttgataacgaaatcggctataactttgccagcgagatgttccgccagcgcgtactggtggccggaacgctcaataacgccaaaacgatccgcattgaaccgccactgacactgaccattgaacagtgtgaactggtgatcaaagcggcgcgtaaggcgctggcggccatgcgagtaagtgtcgaagaagcgtaa

SEQ ID NO: 47248 - DNA, 3129 bp, Escherichia coli
atgaatggttccgatttctctctaccgggaggccctatgaatcgctgggaaaacattcagctcacccacgaaaaccgacttgcgccgcgtgcgtactttttttcatatgattctgttgcgcaagcgcgtacctttgcccgcgaaaccagcagcctgtttctgcccttaagcggtcagtggaatttccacttttttgaccatccgctgcaagtaccagaagccttcacctctgagttaatggctgactgggggcatattaccgtccccgccatgtggcaaatggaaggtcacggcaaactgcaatataccgacgaaggttttccgttccccatcgatgtgccgtttgtccccagcgataacccaaccggtgcctatcaacgtattttcaccctcagcgacggctggcagggtaaacagacgctgattaaatttgacggcgtcgaaacctattttgaagtctatgttaacggtcagtatgtgggtttcagcaagggcagtcgcctgaccgcagagtttgacatcagcgcgatggttaaaaccggcgacaacctgttgtgtgtgcgcgtgatgcagtgggcggactctacctacgtggaagaccaggatatgtggtggtcagcggggatcttccgcgatgtttatctggtcggaaaacacctaacgcatattaacgatttcactgtgcgtaccgactttgacgaagcctattgcgatgccacgctttcctgcgaagtggtgctggaaaatctcgccgcctcccctgtcgtcacgacgctggaatataccctgtttgatggcgaacgcgtggtgcacagcagcgccattgatcatttggcaattgaaaaactgaccagcgccacgtttgcttttactgtcgaacagccgcagcaatggtcagcagaatccccttatctttaccatctggtcatgacgctgaaagacgccaacggcaacgttctggaagtggtgccacaacgcgttggcttccgtgatatcaaagtgcgcgacggtctgttctggatcaataaccgttatgtgatgctgcacggcgtcaaccgtcacgacaacgatcatcgcaaaggccgcgccgttggaatggatcgcgtcgagaaagatctccagttgatgaagcagcacaatatcaactccgtgcgtaccgctcactacccgaacgatccgcgtttttacgaactgtgtgatatctacggcctgtttgtgatggcggaaaccgacgtcgaatcgcacggctttgctaatgtcggcgatattagccgtattaccgacgatccgcagtgggaaaaagtctacgtcgagcgcattgttcgccatatccacgcgcagaaaaaccatccgtcgatcatcatctggtcgctgggcaatgaatccggctatggctgtaacatccgcgcgatgtaccatgcggcgaaagcgctggatgacacgcgactggtgcattacgaagaagatcgcgatgctgaagtggtcgatattatttccaccatgtacacccgcgtgccgctgatgaatgagtttggtgaatacccgcatccgaagccgcgcatcatctgtgaatatgctcatgcgatggggaacggaccgggcgggctgacggagtaccagaacgtcttctataagcacgattgcattcagggtcattatgtctgggagtggtgcgaccacgggatccaggcacaggacgaccacggcaatgtctggtataaattcggcggcgactacggcgactatcccaacaactataacttctgtcttgatggtttgatctattccgatcagacgccgggaccgggcctgaaagagtacaaacaggttatcgcgccggtaaaaatccacgcgcgggatctgactcgcggcgagttgaaagtcgaaaataaactgtggtttaccacgcttgatgactacaccctgcacgcagaggtgcgcgccgaaggtgaaacgctcgcgacgcagcagattaaactgcgcgacgttgcgccgaacagcgaagcccccttgcagatcacgctgccgcagctggacgcccgcgaagcgttcctcaacattacggtgaccaaagattcccgcacccgctacagcgaagccggacaccctatcgccacttatcagttcccgctgaaggaaaacaccgcgcagccagtgcctttcgcaccaaataatgcgcgtccgctgacgctggaagacgatcgtttgagctgcaccgttcgcggctacaacttcgcgatcaccttctcaaaaatgagtggcaaaccgacatcctggcaggtgaatggcgaatcgctgctgactcgcgagccaaagatcaacttcttcaagccgatgatcgacaaccacaagcaggagtacgaagggctgtggcaaccgaatcatttgcagatcatgcaggaacatctgcgcgactttgccgtagaacagagcgatggtgaagtgctgatcatcagccgcacagttattgccccgccggtgtttgacttcgggatgcgctgcacctacatctggcgcatcgctgccgatggccaggttaacgtggcgctttccggcgagcgttacggcgactatccgcacatcattccgtgcatcggtttcaccatgggaattaacggcgaatacgatcaggtggcgtattacggtcgtggaccgggcgaaaactacgccgacagccagcaggctaacatcatcgatatctggcgccaagccgtcgatgccatgttcgagaactatcccttcccgcagaacaacggtaaccgtcagcatgtccgctggacggcactgactaaccgccacggtaacggtctgctggtggttccgcagcgcccaattaacttcagcgcctggcactatacccaggaaaacatccacgctgcccagcactgtaacgagctgcagcgcagtgatgacatcaccctgaacctcgatcaccagctgcttggcctcggctccaactcctggggcagcgaggtgctggactcctggcgcgtctggttccgtgacttcagctacggctttacgttgctgccggtttctggcggagaagctaccgcgcaaagcctggcgtcgtatgagttcggcgcagggttcttttccacgaatttgcacagcgagaataagcaatga

SEQ ID NO: 47249 - DNA, 1335 bp, Escherichia coli
atgattctggacaccgttgacgaaaaaaagaaaggcgtgcatacccgctatttaatattactgattatttttattgttaccgccgttaactacgccgatcgtgcaacgctgtctattgctggtaccgaagtggcaaaagagttgcagttaagtgcggtttcgatgggttacatcttctccgcttttggctgggcctacttgctgatgcaaatccccggcggctggctgcttgataagtttggctcgaaaaaagtttacacctacagcctctttttctggtcgctattcaccttcctgcaaggctttgttgatatgttcccgctggcctgggcagggatctccatgttctttatgcgctttatgctcggcttctcggaagcgccatcattcccggcgaacgcccgaattgtcgccgcctggttcccgacgaaagaacgtggtactgcctccgccatctttaactcggcgcaatatttctcgctggcgctcttttcgccgctgcttggctggctgactttcgcctggggctgggagcacgtctttaccgttatgggggtgattggttttgtgctgacggcgctgtggatcaagttgattcataacccgacagatcacccacgtatgtctgcggaagagctgaagtttatctctgaaaatggcgcggtggtcgatatggaccacaaaaagccgggcagtgcggcagcaagcggacccaaactgcattacatcaagcaattgctctctaaccgcatgatgctgggcgtatttttcggacaatattttatcaacaccatcacctggttcttcctcacctggttcccgatttatctggtgcaggaaaaaggcatgtcgattctgaaagtgggtctggtcgcctcgattccagcactgtgtggttttgcgggcggcgtgctgggaggtgtcttctcggattatctgatcaaacgcggtttatccctgaccctggcacgtaagctaccgattgtgctgggaatgttgctggcttccaccatcatcttatgtaactacaccaacaacaccacgctggtggtcatgctgatggcgctggctttctttggcaaaggatttggtgcgctgggctggccggtgatttctgacaccgcgccgaaagagattgttggcctctgcggcggcgtctttaacgtctttggcaatgttgcctccattgtcactccactggtgattggctacctggtaagtgaactgcactccttcaatgcagcactggttttcgtgggatgttcagcgctgatggcgatggtctgctacctcttcgtagttggcgacattaaacgtatggaattgcagaaataa

SEQ ID NO: 47250 - DNA, 861 bp, Escherichia coli
atgagcattatctccactaaatatctgttacaggacgcccaggccaatggctacgcggtgcctgcttttaacattcataacgccgagacgatccaagcgatcctcgaagtgtgcagtgaaatgcgatcgccggtgatcctcgccggaacgccggggacctttaaacacatcgcgctggaagagatctacgccctgtgtagcgcctattccacaacctacaacatgccactggcgctgcatctcgaccaccacgaatcgctggatgatattcgccgtaaagtccacgcaggtgtgcgcagtgcgatgatcgacggcagccacttcccgtttgccgagaacgtgaagctggtgaaatcggttgttgacttctgccactcacaagattgcagcgtggaagcagaactgggccgcctgggcggtgttgaagatgacatgagcgttgacgccgaaagtgcattcctgaccgatccacaagaagctaaacgctttgtcgaactgactggcgtcgacagcctggcggtagcgattggtacggcgcacggcttatacagcaaaacgccgaagattgatttccagcggctggcggaaattcgtgaagtggtggatgttcctctggtgctgcatggtgccagcgatgttccggatgaatttgtccgtcgcactattgaacttggcgtcacaaaagtgaacgttgccacagaattaaaaatagccttcgctggcgcggttaaagcctggtttgcggaaaatccgcagggtaatgatcctcgttattatatgcgcgtcggaatggatgcgatgaaagaagttgtcagaaataaaattaatgtctgtggttcagcgaatcgaatttcagcataa

SEQ ID NO: 47251 - DNA, 2673 bp, Escherichia coli
atgacagatgtaacgattaaaacgctggccgcagagcgacagacctccgtggaacgcctggtacagcaatttgctgatgcaggtatccggaagtctgctgacgactctgtgtctgcacaagagaaacagactttgattgaccacctgaatcagaaaaattcaggcccggacaaattgacgctgcaacgtaaaacacgcagcacccttaacattcctggtaccggtggaaaaagcaaatcggtacaaatcgaagtccgcaagaaacgcacctttgtgaaacgcgatccgcaagaggctgaacgccttgcagcggaagagcaagcgcagcgtgaagcggaagagcaagcccgtcgtgaggcagaagaatcggctaaacgcgaggcgcaacaaaaagctgaacgtgaggccgcagaacaagctaagcgtgaagctgctgaacaagcgaaacgtgaagctgcggaaaaagacaaagtgagcaatcaacaagacgatatgactaaaaacgcccaggctgaaaaagcccgccgtgagcaggaagctgcagagctcaagcgtaaagctgaagaagaagcgcgtcgtaaactcgaagaagaagcacgtcgcgttgctgaagaagcacgtcgtatggcggaagaaaacaaatggactgataacgcggaaccgactgaagattccagcgattatcacgtcactacttctcaacatgctcgccaggcagaagacgaaagcgatcgtgaagtcgaaggcggccgtggccgtggtcgtaacgcgaaagcagcgcgtccgaagaaaggcaacaaacacgctgaatcaaaagctgatcgtgaagaagcacgcgcagcagtacgtggcggtaaaggcggaaaacgtaaaggttcttcgctgcagcaaggcttccagaagcctgctcaggccgttaaccgtgacgttgtgatcggcgaaactatcaccgttggcgaactggcgaacaagatggcggttaaaggctctcaggtcatcaaagcgatgatgaaactgggcgcaatggcaaccatcaaccaggttatcgatcaggaaaccgcacagctggttgctgaagagatgggccataaagttatcctgcgtcgtgaaaacgagctggaagaggcggtaatgagcgaccgtgacacgggtgctgcggctgaaccgcgcgcgccggttgtgaccatcatgggtcacgttgaccacggtaaaacctctctgctggactacattcgttcaacgaaagtggcctctggcgaagcgggcggcattacccagcacattggtgcataccacgttgaaactgaaaacggcatgatcaccttcctggacaccccggggcacgccgcgtttacttcaatgcgtgctcgtggtgcgcaggcaacggacatcgtagtcctggttgttgctgccgacgacggtgtgatgccgcagaccatcgaagcaatccagcacgcgaaagcggcgcaggtaccggtggtggttgcagtgaacaagatcgataaaccagaagctgatccggatcgcgttaagaacgaactctcccagtacggcatcctgccggaagagtggggcggtgaaagccagttcgtacacgtatctgcgaaagcgggtaccggtatcgatgaactgctggacgctatcctgctgcaggcggaagttctggagctgaaagcggtacgtaaaggtatggcgagcggtgcggttatcgaatccttcctcgataaaggtcgtggtccggttgctaccgttctggtacgtgaaggtactctgcacaagggcgatatcgttctgtgtggcttcgaatacggtcgtgttcgtgcgatgcgtaacgaactgggtcaggaagtgctggaagcgggtccgtccattccggtggaaatcctcggcctgtccggcgtaccggctgcgggtgatgaagttaccgttgtacgtgacgagaagaaagcgcgtgaagttgcactctatcgtcagggtaaattccgcgaagttaaactggcgcgtcagcagaaatctaaactcgagaacatgttcgccaacatgaccgaaggcgaagttcacgaagtgaatatcgtcctgaaggcagacgtacagggttctgtcgaagcgatctccgactccttgctgaaactgtctactgacgaagttaaagtgaagatcatcggttctggcgtaggtggtatcaccgaaaccgacgccaccctggctgcggcgtccaacgccatcctggttggctttaacgtacgtgctgatgcctctgcacgtaaagtgattgaagcggaaagcctggatctgcgttactactccgtcatctataacctgattgacgaagtgaaagcggcgatgagcggtatgctgtctccggaactgaaacagcagattatcggtctggcggaagttcgtgacgtgttcaaatcgccgaaatttggtgccatcgcaggctgtatggttaccgaaggtgtggttaaacgtcacaacccgatccgcgttctgcgtgacaacgtggttatctacgaaggcgagctggagtccctgcgccgcttcaaagatgacgttaacgaagtccgtaacggtatggaatgtggtatcggcgttaagaactacaacgacgtccgcactggcgatgtgatcgaagtattcgaaatcatcgagatccaacgtaccattgcttaa

SEQ ID NO: 47252 - DNA, 1344 bp, Escherichia coli
atgacgacgattctcaagcatctcccggtaggtcaacgtattggtatcgctttttctggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccaccggcggcctgacctatttcaacacgacgccgctgggccgcgccgtgactggtaccatgctggttgctgcgatgaaagaagatggcgtgaatatctggggtgacggtagcacctacaaaggaaacgatatcgaacgtttctatcgttatggtctgctgaccaatgctgaactgcagatttacaaaccgtggcttgatactgactttattgatgaactgggcggccgtcatgagatgtctgaatttatgattgcctgcggtttcgactacaaaatgtctgtcgaaaaagcctactccacagactccaacatgcttggtgcaacgcatgaagcgaaggatctggaatacctcaactccagcgtcaaaatcgtcaacccgattatgggcgtgaaattctgggatgagagcgtgaagatcccggcagaagaagtcacagtacgctttgaacaaggtcatccggtggcgctgaacggtaaaacctttagcgacgacgtagaaatgatgctggaagctaaccgcatcggcggtcgtcacggcctgggcatgagcgaccagattgaaaaccgtatcatcgaagcgaaaagccgtggtatttacgaagctccggggatggcactgctgcacattgcgtatgaacgcctgttgaccggtattcacaacgaagacaccattgagcagtatcacgcgcatggtcgtcagttgggccgtctgctgtaccaggggcgttggtttgactcccaggcgctgatgctgcgtgactctctgcaacgctgggttgccagccagatcactggtgaagttaccctggagctgcgccgtgggaacgattattcaatcctgaataccgtctcagagaacctgacctacaagccagagcgtctgacgatggaaaaaggcgactcggtgttctcgccagatgatcgtattggtcaattgaccatgcgtaacctggatatcactgatacccgcgagaaacttttcggttatgccaaaactggcctgctttcctcctctgccgcttcaggcgtgccgcaggtggagaatctggaaaacaaaggccagtaa

SEQ ID NO: 47253 - DNA, 1338 bp, Escherichia coli
atgagtaatcgtaaatatttcggtaccgatgggattcgtggtcgtgtaggggatgcgccgatcacacctgattttgtgcttaagctgggttgggccgcgggtaaagtgctggcgcgccacggctcccgtaagattattattggtaaagacacgcgtatttctggctatatgctggagtcagcactggaagcgggtctggcggcagcgggcctttccgcactcttcactggcccgatgccaacaccggccgtggcttatctgacgcgtaccttccgcgcagaggccggaattgtgatatctgcatcgcataacccgttctacgataatggcattaaattcttctctatcgacggcaccaaactgccggatgcggtagaagaggccatcgaagcggaaatggaaaaggagatcagctgcgttgattcggcagaactgggtaaagccagccgtatcgttgatgccgcgggtcgctatatcgagttttgcaaagccacgttcccgaacgaacttagcctcagtgaactgaagattgtggtggattgtgcaaacggtgcgacttatcacatcgcgccgaacgtgctgcgcgaactgggggcgaacgttatcgctatcggttgtgagccaaacggtgtaaacatcaatgccgaagtgggggctaccgacgttcgcgcgctccaggctcgtgtgctggctgaaaaagcggatctcggtattgccttcgacggcgatggcgatcgcgtgattatggttgaccatgaaggcaataaagtcgatggcgatcagatcatgtatatcatcgcgcgtgaaggtcttcgtcagggccagctgcgtggtggcgctgtgggtacattgatgagcaacatggggcttgaactggcgctgaaacagttaggaattccatttgcgcgcgcgaaagtgggtgaccgctacgtactggaaaaaatgcaggagaaaggctggcgtatcggtgcagagaattccggtcatgtgatcctgctggataaaactactaccggtgacggcatcgttgctggcttgcaggtgctggcggcgatggcacgtaaccatatgagcctgcacgacctttgcagcggcatgaaaatgttcccgcagattctggttaacgtacgttacaccgcaggtagcggcgatccacttgagcatgagtcagttaaagccgtgaccgcagaggttgaagctgcgctgggcaaccgtggacgcgtgttgctgcgtaaatccggcaccgaaccgttaattcgcgtgatggtggaaggcgaagacgaagcgcaggtgactgaatttgcacaccgcatcgccgatgcagtaaaagccgtttaa

SEQ ID NO: 47254 - DNA, 1935 bp, Escherichia coli
atggcgaaaaacctaatactctggctggtcattgccgttgtgctgatgtcagtattccagagctttgggcccagcgagtctaatggccgtaaggtggattactctaccttcctacaagaggtcaataacgaccaggttcgtgaagcgcgtatcaacggacgtgaaatcaacgttaccaagaaagatagtaaccgttataccacttacattccggttcaggatccgaaattactggataacctgttgaccaagaacgtcaaggttgtcggtgaaccgcctgaagaaccaagcctgctggcttctatcttcatctcctggttcccgatgctgttgctgattggtgtctggatcttcttcatgcgtcaaatgcagggcggcggtggcaaaggtgccatgtcgtttggtaagagcaaagcgcgcatgctgacggaagatcagatcaaaacgacctttgctgacgttgcgggctgcgacgaagcaaaagaagaagttgctgaactggttgagtatctgcgcgagccgagccgcttccagaaactcggcggtaagatcccgaaaggcgtcttgatggtcggtcctccgggtaccggtaaaacgctgctggcgaaagcgattgcaggcgaagcgaaagttccgttctttactatctccggttctgacttcgtagaaatgttcgtcggtgtgggtgcatcccgtgttcgtgacatgttcgaacaggcgaagaaagcggcaccgtgcatcatctttatcgatgaaatcgacgccgtaggccgccagcgtggcgctggtctgggcggtggtcacgatgaacgtgaacagactctgaaccagatgctggttgagatggatggcttcgaaggtaacgaaggtatcatcgttatcgccgcgactaaccgtccggacgttctcgacccggccctgctgcgtcctggccgtttcgaccgtcaggttgtggtcggcttgccagatgttcgcggtcgtgagcagatcctgaaagttcacatgcgtcgcgtaccattggcacccgatatcgacgcggcaatcattgcccgtggtactcctggtttctccggtgctgacctggcgaacctggtgaacgaagcggcactgttcgctgctcgtggcaacaaacgcgttgtgtcgatggttgagttcgagaaagcgaaagacaaaatcatgatgggtgcggaacgtcgctccatggtgatgacggaagcgcagaaagaatcgacggcttaccacgaagcgggtcatgcgattatcggtcgcctggtgccggaacacgatccggtgcacaaagtgacgattatcccacgcggtcgtgcgctgggtgtgactttcttcttgcctgagggcgacgcaatcagcgccagccgtcagaaactggaaagccagatttctacgctgtacggtggtcgtctggcagaagagatcatctacgggccggaacatgtatctaccggtgcgtccaacgatattaaagttgcgaccaacctggcacgtaacatggtgactcagtggggcttctctgagaaattgggtccactgctgtacgcggaagaagaaggtgaagtgttcctcggccgtagcgtagcgaaagcgaaacatatgtccgatgaaactgcacgtatcatcgaccaggaagtgaaagcactgattgagcgtaactataatcgtgcgcgtcagcttctgaccgacaatatggatattctgcatgcgatgaaagatgctctcatgaaatatgagactatcgacgcaccgcagattgatgacctgatggcacgtcgcgatgtacgtccgccagcgggctgggaagaaccaggcgcttctaacaattctggcgacaatggtagtccaaaggctcctcgtccggttgatgaaccgcgtacgccgaacccgggtaacaccatgtcagagcagttaggcgacaagtaa

SEQ ID NO: 47255 - DNA, 972 bp, Escherichia coli
atgaatttagaaaaaatcaatgagttaaccgcgcaagatatggcgggtgttaatgcggcaatccttgagcagcttaattccgacgtccaactgatcaatcagttaggctattacatcgtcagcggcggcggtaaacgtattcgtccgatgattgctgtactggctgcacgagctgttggctatgagggaaatgcgcatgtcaccattgctgccctgatcgagtttatccacacggcgactctgctacacgacgacgttgtggatgaatcagatatgcgcaggggtaaagctaccgccaacgccgcatttggcaatgccgccagcgtgctggtaggcgattttatttatacccgcgctttccagatgatgaccagcctcggttcgctcaaagtgctggaagtcatgtcagaagccgtaaacgtcatcgcagaaggtgaagttctgcaactgatgaacgttaacgatccggacatcactgaagaaaactacatgcgcgttatctatagcaaaaccgcgcgtctgtttgaggctgccgcgcagtgttccgggattctggctggctgtacgccggaggaggagaaaggcctgcaggattatgggcgctatctcggcactgctttccagttgatcgacgatttactcgattacaatgccgatggcgaacagttaggtaaaaatgtcggcgacgatctgaacgaaggtaaaccgacgctgccgctgctgcatgcgatgcatcatggcacaccagaacaggcacagatgatccgtaccgccatcgaacagggtaacggtcgccatcttctggaaccggttctggaagcaatgaacgcttgtggatctcttgaatggacgcgtcagcgtgccgaggaagaagcagacaaagccatcgcagcgttacaggtgctcccggacaccccttggcgagaagcactcatcggcctcgcgcacatcgctgttcaacgcgatcgttaa

SEQ ID NO: 47256 - DNA, 1260 bp, Escherichia coli
atggataaatttcgtgttcaggggccaacgaagctccagggcgaagtcacaatttccggcgctaaaaatgctgctctgcctatcctttttgccgcactactggcggaagaaccggtagagatccagaacgtcccgaaactgaaagacgtcgatacatcaatgaagctgctaagccagctgggtgcgaaagtagaacgtaatggttctgtgcatattgatgcccgcgacgttaatgtattctgcgcaccttacgatctggttaaaaccatgcgtgcttctatctgggcgctggggccgctggtagcgcgctttggtcaggggcaagtttcactacctggcggttgtacgatcggtgcgcgtccggttgatctacacatttctggcctcgaacaattaggcgcgaccatcaaactggaagaaggttacgttaaagcttccgtcgatggtcgtttgaaaggtgcacatatcgtgatggataaagtcagcgttggcgcaacggtgaccatcatgtgtgctgcaaccctggcggaaggcaccacgattattgaaaacgcagcgcgtgaaccggaaatcgtcgataccgcgaacttcctgattacgctgggtgcgaaaattagcggtcagggcaccgatcgtatcgtcatcgaaggtgtggaacgtttaggcggcggtgtctatcgcgttctgccggatcgtatcgaaaccggtactttcctggtggcggcggcgatttctcgcggcaaaattatctgccgtaacgcgcagccagatactctcgacgccgtgctggcgaaactgcgtgacgctggagcggacatcgaagtcggcgaagactggattagcctggatatgcatggcaaacgtccgaaggctgttaacgtacgtaccgcgccgcatccggcattcccgaccgatatgcaggcccagttcacgctgttgaacctggtggcagaagggaccgggtttatcaccgaaacggtctttgaaaaccgctttatgcatgtgccagagctgagccgtatgggcgcgcacgccgaaatcgaaagcaataccgttatttgtcacggtgttgaaaaactttctggcgcacaggttatggcaaccgatctgcgtgcatcagcaagcctggtgctggctggctgtattgcggaagggacgacggtggttgatcgtatttatcacatcgatcgtggctacgaacgcattgaagacaaactgcgcgctttaggtgcaaatattgagcgtgtgaaaggcgaataa

SEQ ID NO: 47257 - DNA, 894 bp, Escherichia coli
atggcaacgaatttacgtggcgtaatggctgcactcctgactccttttgaccaacaacaagcactggataaagcgagtctgcgtcgcctggttcagttcaatattcagcagggcatcgacggtttatacgtgggtggttcgaccggcgaggcctttgtacaaagcctttccgagcgtgaacaggtactggaaatcgtcgccgaagaggcgaaaggtaagattaaactcatcgcccacgtcggttgcgtcagcaccgccgaaagccaacaacttgcggcatcggctaaacgttatggcttcgatgccgtctccgccgtcacgccgttctactatcctttcagctttgaagaacactgcgatcactatcgggcaattattgattcggcggatggtttgccgatggtggtgtacaacattccagccctgagtggggtaaaactgaccctggatcagatcaacacacttgttacattgcctggcgtaggtgcgctgaaacagacctctggcgatctctatcagatggagcagatccgtcgtgaacatcctgatcttgtgctctataacggttacgacgaaatcttcgcctctggtctgctggcgggcgctgatggtggtatcggcagtacctacaacatcatgggctggcgctatcaggggatcgttaaggcgctgaaagaaggcgatatccagaccgcgcagaaactgcaaactgaatgcaataaagtcattgatttactgatcaaaacgggcgtattccgcggcctgaaaactgtcctccattatatggatgtcgtttctgtgccgctgtgccgcaaaccgtttggaccggtagatgaaaaatatctgccagaactgaaggcgctggcccagcagttgatgcaagagcgcgggtga

SEQ ID NO: 47258 - DNA, 939 bp, Escherichia coli
atgaaagtcgcagtcctcggcgctgctggcggtattggccaggcgcttgcactactgttaaaaacccaactgccttcaggttcagaactctctctgtatgatatcgctccagtgactcccggtgtggctgtcgatctgagccatatccctactgctgtgaaaatcaaaggtttttctggtgaagatgcgactccggcgctggaaggcgcagatgtcgttcttatctctgcaggcgtagcgcgtaaaccgggtatggatcgttccgacctgtttaacgttaacgccggcatcgtgaaaaacctggtacagcaagttgcgaaaacctgcccgaaagcgtgcattggtattatcactaacccggttaacaccacagttgcaattgctgctgaagtgctgaaaaaagccggtgtttatgacaaaaacaaactgttcggcgttaccacgctggatatcattcgttccaacacctttgttgcggaactgaaaggcaaacagccaggcgaagttgaagtgccggttattggcggtcactctggtgttaccattctgccgctgctgtcacaggttcctggcgttagttttaccgagcaggaagtggctgatctgaccaaacgcatccagaacgcgggtactgaagtggttgaagcgaaggccggtggcgggtctgcaaccctgtctatgggccaggcagctgcacgttttggtctgtctctggttcgtgcactgcagggcgaacaaggcgttgtcgaatgtgcctacgttgaaggcgacggtcagtacgcccgtttcttctctcaaccgctgctgctgggtaaaaacggcgtggaagagcgtaaatctatcggtaccctgagcgcatttgaacagaacgcgctggaaggtatgctggatacgctgaagaaagatatcgccctgggcgaagagttcgttaataagtaa

SEQ ID NO: 47259 - DNA, 1350 bp, Escherichia coli
atgctggataaaattgttattgccaaccgcggcgagattgcattgcgtattcttcgtgcctgtaaagaactgggcatcaagactgtcgctgtgcactccagcgcggatcgcgatctaaaacacgtattactggcagatgaaacggtctgtattggccctgctccgtcagtaaaaagttatctgaacatcccggcaatcatcagcgccgctgaaatcaccggcgcagtagcaatccatccgggttacggcttcctctccgagaacgccaactttgccgagcaggttgaacgctccggctttatcttcattggcccgaaagcagaaaccattcgcctgatgggcgacaaagtatccgcaatcgcggcgatgaaaaaagcgggcgtcccttgcgtaccgggttctgacggcccgctgggcgacgatatggataaaaaccgtgccattgctaaacgcattggttatccggtgattatcaaagcctccggcggcggcggcggtcgcggtatgcgcgtagtgcgcggcgacgctgaactggcacaatccatctccatgacccgtgcggaagcgaaagctgctttcagcaacgatatggtttacatggagaaatacctggaaaatcctcgccacgtcgagattcaggtactggctgacggtcagggcaacgctatctatctggcggaacgtgactgctccatgcaacgccgccaccagaaagtggtcgaagaagcgccagcaccgggcattaccccggaactgcgtcgctacatcggcgaacgttgcgctaaagcgtgtgttgatatcggctatcgcggtgcaggtactttcgagttcctgttcgaaaacggcgagttctatttcatcgaaatgaacacccgtattcaggtagaacacccggttacagaaatgatcaccggcgttgacctgatcaaagaacagctgcgtatcgctgccggtcaaccgctgtcgatcaagcaagaagaagttcacgttcgcggccatgcggtggaatgtcgtatcaacgccgaagatccgaacaccttcctgccaagtccgggcaaaatcacccgtttccacgcacctggcggttttggcgtacgttgggagtctcatatctacgcgggctacaccgtaccgccgtactatgactcaatgatcggtaagctgatttgctacggtgaaaaccgtgacgtggcgattgcccgcatgaagaatgcgctgcaggagctgatcatcgacggtatcaaaaccaacgttgatctgcagatccgcatcatgaatgacgagaacttccagcatggtggcactaacatccactatctggagaaaaaactcggtcttcaggaaaaataa

SEQ ID NO: 47260 - DNA, 819 bp, Escherichia coli
atggaaacctatgctgtttttggtaatccgatagcccacagcaaatcgccattcattcatcagcaatttgctcagcaactgaatattgaacatccctatgggcgcgtgttggcacccatcaatgatttcatcaacacactgaacgctttctttagtgctggtggtaaaggtgcgaatgtgacggtgccttttaaagaagaggcttttgccagagcggatgagcttactgaacgggcagcgttggctggtgctgttaataccctcatgcggttagaagatggacgcctgctgggtgacaataccgatggtgtaggcttgttaagcgatctggaacgtctgtcttttatccgccctggtttacgtattctgcttatcggcgctggtggagcatctcgcggcgtactactgccactcctttccctggactgtgcggtgacaataactaatcggacggtatcccgcgcggaagagttggctaaattgtttgcgcacactggcagtattcaggcgttgagtatggacgaactggaaggtcatgagtttgatctcattattaatgcaacatccagtggcatcagtggtgatattccggcgatcccgtcatcgctcattcatccaggcatttattgctatgacatgttctatcagaaaggaaaaactccttttctggcatggtgtgagcagcgaggctcaaagcgtaatgctgatggtttaggaatgctggtggcacaggcggctcatgcctttcttctctggcacggtgttctgcctgacgtagaaccagttataaagcaattgcaggaggaattgtccgcgtga

SEQ ID NO: 47261 - DNA, 822 bp, Escherichia coli
atggcagttgttaaatgtaaaccgacatctccgggtcgtcgccacgtagttaaagtggttaaccctgagctgcacaagggcaaaccttttgctccgttgctggaaaaaaacagcaaatccggtggtcgtaacaacaatggccgtatcaccactcgtcatatcggtggtggccacaagcaggcttaccgtattgttgacttcaaacgcaacaaagacggtatcccggcagttgttgaacgtcttgagtacgatccgaaccgttccgcgaacatcgcgctggttctgtacaaagacggtgaacgccgttacatcctggcccctaaaggcctgaaagctggcgaccagattcagtctggcgttgatgctgcaatcaaaccaggtaacaccctgccgatgcgcaacatcccggttggttctactgttcataacgtagaaatgaaaccaggtaaaggcggtcagctggcacgttccgctggtacttacgttcagatcgttgctcgtgatggtgcttatgtcaccctgcgtctgcgttctggtgaaatgcgtaaagtagaagcagactgccgtgcaactctgggcgaagttggcaatgctgagcatatgctgcgcgttctgggtaaagcaggtgctgcacgctggcgtggtgttcgtccgaccgttcgcggtaccgcgatgaacccggtagaccacccacatggtggtggtgaaggtcgtaactttggtaagcacccggtaactccgtggggcgttcagaccaaaggtaagaagacccgcagcaacaagcgtactgataaattcatcgtacgtcgccgtagcaaataa

SEQ ID NO: 47262 - DNA, 1221 bp, Escherichia coli
atggcaattgaacaaacagcaattacacgcgcgactttcgatgaagtgatcctgccgatttatgctccggcagagtttattccggtaaaaggtcagggcagccgaatctgggatcagcaaggcaaggagtatgtcgatttcgcgggtggcattgcagttacggcgttgggccattgccatcctgcgctggtgaacgcgttaaaaacccagggcgaaactctgtggcatatcagtaacgttttcaccaatgaaccggcgctgcgtcttgggcgtaaactgattgaggcaacgtttgccgaacgcgtggtgtttatgaactccggcacggaagctaacgaaaccgcctttaaactggcacgccattacgcctgtgtgcgtcatagcccgttcaaaaccaaaattattgccttccataacgcttttcatggtcgctcgctgtttaccgtttcggtgggtgggcagccaaaatattccgacggctttgggccgaaaccggcagacatcatccacgttccctttaacgatctccatgcagtgaaagcggtgatggatgatcacacctgtgcggtggtggttgagccgatccagggcgagggcggtgtgacggcagcgacgccagagtttttgcagggcttgcgcgagctgtgcgatcaacatcaggcattattggtgtttgatgaagtgcagtgcgggatggggcggaccggcgatttgtttgcttacatgcactacggcgttacgccggatattctgacctctgcgaaagcgttaggcggcggcttcccgattagcgccatgctgaccacggcggaaattgcttctgcgtttcatcctggttctcacggttccacctacggcggtaatcctctggcctgtgcagtagcgggggcggcgtttgatatcatcaatacccctgaagtgctggaaggcattcaggcgaaacgccagcgttttgttgaccatctgcagaagatcgatcagcagtacgatgtatttagcgatattcgcggtatggggctgttgattggcgcagagctgaaaccacagtacaaaggtcgggcgcgtgatttcctgtatgcgggcgcagaggctggcgtaatggtgctgaatgccggaccggatgtgatgcgttttgcaccgtcgctggtggtggaagatgcggatatcgatgaagggatgcaacgtttcgcccacgcggtggcgaaggtggttggggcgtaa

SEQ ID NO: 47263 - DNA, 1389 bp, Escherichia coli
atgactgcaaactctcccctacaacgtattggacaagaaaaaggtatcgctatgggaagccaggaactccaacgcaagctcggattttgggccgttcttgcaatcgccgtcgggacaaccgtcggctccggtatttttgtatctgtgggtgaagtggcaaaagcagcgggcacgccgtggcttacggtgctcgcgtttgtcattggcgggttaattgtgatcccgcaaatgtgcgtctatgcggaactatccaccgcttatccggaaaatggcgcagattatgtttatctgaaaaatgccggaagccgaccgctggctttcctctccggctgggccagcttctgggccaacgatgcgccgtcattgtcgattatggcgctggcgattgtcagcaatcttggctttttaacgcctatcgatccgttgctcggtaaatttatcgccgccggattaattatcgcctttatgttgctacacctgcgctccgttgaaggcggcgcagcgtttcagacgctaattaccatcgccaaaattatcccgttcactatcgtcattggccttgggatcttctggtttaaagcggagaattttgccgcccctaccaccactgcgattggcgcaacgggcagctttatggcgctgctggcggggatctctgccaccagttggtcgtataccggcatggcctctatctgttatatgaccggcgaaattaaaaaccccggaaaaaccatgccacgagcgctgattggttcctgtctgctggttctggtgctctacaccctgctggcgctggtgatttccggcctgatgcccttcgacaaactcgccaattctgaaacgccgatttccgacgccctgacctggatccccgcactcggcagcaccgctgggatctttgttgccatcacggcgatgatcgtcattcttggttcgctttccagctgcgtgatgtaccagccgcggctggaatacgcgatggcgaaagacaacctgttctttaaatgcttcggccatgtgcatccgaaatacaacacgccggatgtctccatcatcctgcaaggggcgctggggatcttcttcatcttcgtttccgatctcaccagcctgctgggttatttcaccctggtgatgtgtttcaaaaataccctcaccttcggctccatcatctggtgtcgtaaacgcgacgattacaaaccgctgtggcgtactccggctttcgggctgatgaccaccctcgccattgcgtcaagcctcattctggtcgcctcaacctttgtctgggcaccgattcccggccttatctgcgccgtcatcgttattgctactggtctgcctgcttacgccttctgggcgaagcgtagccgccagctcaacgctttgtcgtaa

SEQ ID NO: 47264 - DNA, 786 bp, Escherichia coli
atgaaaaccctggcgacaatcggcgataactgcgtcgatatctacccgcaactgaataaagcgttttctggcggtaatgcggtcaatgtggcggtgtactgcactcgctacggcatacagccgggatgcattacctgggtgggtgacgatgactacggcacaaagctgaagcaggatctcgcccgcatgggcgtcgatatcagccatgtccatacgaaacacggcgttaccgcacaaactcaggtggaactgcacgacaatgatcgcgtttttggcgactacaccgaaggcgtgatggccgactttgccctgagtgaagaggattacgcctggctggcgcagtatgacattgtgcacgcggcaatctggggacatgcggaagacgcattcccacagctgcacgctgcgggcaaacttaccgctttcgacttctccgacaagtgggacagcccgctctggcagacactggtgccgcatctcgattttgcctttgcctccgcaccgcaagaagacgaaacgctgcgtctgaagatgaaagcgattgttgcccgtggcgcaggaacagtgattgtcacgctgggtgaaaacggcagcattgcctgggatggcgcgcagttctggcgtcaggctcctgaaccggtgacggttatcgacaccatgggtgccggagattcgttcattgccggattcctttgcggctggtctgcggggatgacattaccgcaggcgatagcgcagggaacggcgtgcgcggcgaaaaccattcagtaccacggtgcctggtag

SEQ ID NO: 47265 - DNA, 759 bp, Escherichia coli
atgaataagtttgaagatattcgcggcgtcgcttttgatcttgatggtacgctggtcgacagtgctcctggtcttgctgctgcggtagatatggcgctgtatgcgctggagttgcccgtcgcaggtgaagaacgcgttattacctggattggtaacggcgcagatgttctgatggagcgcgcattgacctgggcgcgtcaggaacgtgcgactcagcgtaaaacaatgggtaaaccgcccgttgatgacgacattccggcagaagaacaggtacgtattctgcgtaaactgttcgatcgctactatggcgaggttgccgaagaggggacgtttttgttcccgcacgttgccgatacgttgggcgcgttgcaggctaaaggcctgccgctaggcctggtcaccaacaaaccgacgccgttcgtcgcgccgctgctcgaagccttagatatcgccaaatacttcagcgtggtgattggtggtgatgatgtgcaaaacaaaaaaccgcatccggacccgctgttactggtggctgagcggatgggaattgccccacaacagatgctgtttgtcggcgactcacgcaatgatattcaggcggcaaaagcggcaggttgcccatcagttggcttaacctacggatataactacggcgaggctatcgatctcagccagcctgatgtaatttatcagtctataaatgaccttctgcccgcattagggcttccgcatagcgaaaatcaggaatcgaaaaatgactaa

SEQ ID NO: 47266 - DNA, 1089 bp, Escherichia coli
atggagaggattgtcgttactctcggggaacgtagttacccaattaccatcgcatctggtttgtttaatgaaccagcttcattcttaccgctgaaatcgggcgagcaggtcatgttggtcaccaacgaaaccctggctcctctgtatctcgataaggtccgcggcgtacttgaacaggcgggtgttaacgtcgatagcgttatcctccctgacggcgagcagtataaaagcctggctgtactcgataccgtctttacggcgttgttacaaaaaccgcatggtcgcgatactacgctggtggcgcttggcggcggcgtagtgggcgatctgaccggcttcgcggcggcgagttatcagcgcggtgtccgtttcattcaagtcccgacgacgttactgtcgcaggtcgattcctccgttggcggcaaaactgcggtcaaccatcccctcggtaaaaacatgattggcgcgttctaccaacctgcttcagtggtggtggatctcgactgtctgaaaacgcttcccccgcgtgagttagcgtcggggctggcagaagtcatcaaatacggcattattcttgacggtgcgttttttaactggctggaagagaatctggatgcgttgttgcgtctggacggtccggcaatggcgtactgtattcgccgttgttgtgaactgaaggcagaagttgtcgccgccgacgagcgcgaaaccgggttacgtgctttactgaatctgggacacacctttggtcatgccattgaagctgaaatggggtatggcaattggttacatggtgaagcggtcgctgcgggtatggtgatggcggcgcggacgtcggaacgtctcgggcagtttagttctgccgaaacgcagcgtattataaccctgctcaagcgggctgggttaccggtcaatgggccgcgcgaaatgtccgcgcaggcgtatttaccgcatatgctgcgtgacaagaaagtccttgcgggagagatgcgcttaattcttccgttggcaattggtaagagtgaagttcgcagcggcgtttcgcacgagcttgttcttaacgccattgccgattgtcaatcagcgtaa

SEQ ID NO: 47267 - DNA, 723 bp, Escherichia coli
gtggtagcaaggcagcgcgcttgcagcgaccagatatgcagagggatgggtgatttattcagttgccaaacccgctggagtattgagataattttcagtctgactctcgcaatatcttatgaggtttcagttcatgtcctgcggcgctctctgagcgaagcgggtttatcattaacgaatagtcttagtagtaccgaaaaaatggcagagaaacgcaatatctttctggttgggcctatgggtgccggaaaaagcactattgggcgccagttagctcaacaactcaatatggaattttacgattccgatcaagagattgagaaacgaaccggagctgatgtgggctgggttttcgatttagaaggcgaagaaggcttccgcgatcgcgaagaaaaggtcatcaatgagttgaccgagaaacagggtattgtgctggctactggcggcggctctgtgaaatcccgtgaaacgcgtaaccgtctttccgctcgtggcgttgtcgtttatcttgaaacgaccatcgaaaagcaacttgcacgcacgcagcgtgataaaaaacgcccgttgctgcacgttgaaacaccgccgcgtgaagttctggaagcgttggccaatgaacgcaatccgctgtatgaagagattgccgacgtgaccattcgtactgatgatcaaagcgctaaagtggttgcaaaccagattattcacatgctggaaagcaactaa

SEQ ID NO: 47268 - DNA, 1623 bp, Escherichia coli
atgcgcgttaacaatggtttgaccccgcaagaactcgaggcttatggtatcagtgacgtacatgatatcgtttacaacccaagctacgacctgctgtatcaggaagagctcgatccgagcctgacaggttatgagcgcggggtgttaactaatctgggtgccgttgccgtcgataccgggatcttcaccggtcgttcaccaaaagataagtatatcgtccgtgacgataccactcgcgatactttctggtgggcagacaaaggcaaaggtaagaacgacaacaaacctctctctccggaaacctggcagcatctgaaaggcctggtgaccaggcagctttccggcaaacgtctgttcgttgtcgacgctttctgtggtgcgaacccggatactcgtctttccgtccgtttcatcaccgaagtggcctggcaggcgcattttgtcaaaaacatgtttattcgcccgagcgatgaagaactggcaggtttcaaaccagactttatcgttatgaacggcgcgaagtgcactaacccgcagtggaaagaacagggtctcaactccgaaaacttcgtggcgtttaacctgaccgagcgcatgcagctgattggcggcacctggtacggcggcgaaatgaagaaagggatgttctcgatgatgaactacctgctgccgctgaaaggtatcgcttctatgcactgctccgccaacgttggtgagaaaggcgatgttgcggtgttcttcggcctttccggcaccggtaaaaccaccctttccaccgacccgaaacgtcgcctgattggcgatgacgaacacggctgggacgatgacggcgtgtttaacttcgaaggcggctgctacgcaaaaactatcaagctgtcgaaagaagcggaacctgaaatctacaacgctatccgtcgtgatgcgttgctggaaaacgtcaccgtgcgtgaagatggcactatcgactttgatgatggttcaaaaaccgagaacacccgcgtttcttatccgatctatcacatcgataacattgttaagccggtttccaaagcgggccacgcgactaaggttatcttcctgactgctgatgctttcggcgtgttgccgccggtttctcgcctgactgccgatcaaacccagtatcacttcctctctggcttcaccgccaaactggccggtactgagcgtggcatcaccgaaccgacgccaaccttctccgcttgcttcggcgcggcattcctgtcgctgcacccgactcagtacgcagaagtgctggtgaaacgtatgcaggcggcgggcgcgcaggcttatctggttaacactggctggaacggcactggcaaacgtatctcgattaaagatacccgcgccattatcgacgccatcctcaacggttcgctggataatgcagaaaccttcactctgccgatgtttaacctggcgatcccaaccgaactgccgggcgtagacacgaagattctcgatccgcgtaacacctacgcttctccggaacagtggcaggaaaaagccgaaaccctggcgaaactgtttatcgacaacttcgataaatacaccgacacccctgcgggtgccgcgctggtagcggctggtccgaaactgtaa

SEQ ID NO: 47269 - DNA, 2394 bp, Escherichia coli
atgtcacaacctatttttaacgataagcaatttcaggaagcgctttcacgtcagtggcagcgttatggcttaaattctgcggctgaaatgactcctcgccagtggtggctagcagtgagtgaagcactggccgaaatgctgcgtgctcagccattcgccaagccggtggcgaatcagcgacatgttaactacatctcaatggagtttttgattggtcgcctgacgggcaacaacctgttgaatctcggctggtatcaggatgtacaggattcgttgaaggcttatgacatcaatctgacggacctgctggaagaagagatcgacccggcgctgggtaacggtggtctgggacgtctggcggcgtgcttcctcgactcaatggcaactgtcggtcagtctgcgacgggttacggtctgaactatcaatatggtttgttccgccagtcttttgtcgatggcaaacaggttgaagcgccggatgactggcatcgcagtaactacccgtggttccgccacaacgaagcactggatgtgcaggtagggattggcggtaaagtgacgaaagacggacgctgggagccggagtttaccattaccggtcaagcgtgggatctccccgttgtcggctatcgtaatggcgtggcgcagccgctgcgtctgtggcaggcgacgcacgcgcatccgtttgatctgactaaatttaacgacggtgatttcttgcgtgccgaacagcagggcatcaatgcggaaaaactgaccaaagttctctatccaaacgacaaccatactgccggtaaaaagctgcgcctgatgcagcaatacttccagtgtgcctgttcggtagcggatattttgcgtcgccatcatctggcggggcgtaaactgcacgaactggcggattacgaagttattcagctgaacgatacccacccaactatcgcgattccagaactgctgcgcgtgctgatcgatgagcaccagatgagctgggatgacgcctgggccattaccagcaaaactttcgcttacaccaaccataccctgatgccagaagcgctggaacgctgggatgtgaaactggtgaaaggcttactgccgcgccacatgcagattattaacgaaattaatactcgctttaaaacgctggtagagaaaacctggccgggcgatgaaaaagtgtgggccaaactggcggtggtgcacgacaaacaagtgcatatggcgaacctgtgtgtggttggcggtttcgcggtgaacggtgttgcggcgctgcactcggatctggtggtgaaagatctgttcccggaatatcaccagctatggccgaacaaattccataacgtcaccaacggtattaccccacgtcgctggatcaaacagtgcaacccggcactggcggctctgttggataaatcactgcaaaaagagtgggctaacgatctcgatcagctgatcaatctggaaaaattcgctgatgatgcgaaattccgtcagcaatatcgcgagatcaagcaggcgaataaagtccgtctggcggagtttgtgaaagttcgtaccggtattgagatcaatccacaggcgattttcgatattcagatcaaacgtttgcatgagtacaaacgccagcacctgaatctgctgcatattctggcgttgtacaaagaaattcgtgaaaacccgcaggctgatcgcgtaccgcgcgtcttcctcttcggcgcgaaagcggcaccgggctactacctggcgaagaatattatctttgcgatcaacaaagtggctgacgtgatcaacaacgatccgctggttggcgataagttgaaggtggtgttcctgccggattattgcgtttcggcggcggaaaaactgatcccggcggcggatatctccgaacaaatttcgactgcaggtaaagaagcttccggtaccggcaatatgaaactggcgctcaatggtgcgcttactgtcggtacgctggatggggcgaacgttgaaatcgccgagaaagtcggtgaagaaaatatctttatttttggtcataccgtggaacaagtgaaggcaattctggccaaaggctacgacccggtgaaatggcggaagaaaggtaaggtgctggacgcagtattgaaagagctggaaagcggtaaatacagcgacggcgataagcatgccttcgaccagatgctgcacagtatcggcaaacagggcggcgatccgtatctggtgatggcggatttcgcagcctatgtagaggcacaaaagcaggtggatgtgctgtaccgcgaccaggaggcctggactcgcgcggcgatcctcaataccgcccgctgcggtatgtttagctcggatcgctctattcgcgattatcaggctcgtatctggcaggcaaaacgctaa

SEQ ID NO: 47270 - DNA, 1506 bp, Escherichia coli
atggaaaccaaagatctgattgtgatagggggcggcatcaatggtgctggtatcgcggcagacgccgctggacgcggtttatccgtgctgatgctggaggcgcaggatctcgcttgcgcgacctcttccgccagttcaaaactcattcacggtggcctgcgctaccttgagcactatgaattccgcctggtcagcgaggcgctggctgaacgtgaagtgctgctgaaaatggccccgcatatcgccttcccgatgcgttttcgcctgccacatcgtccgcatctgcgcccggcgtggatgattcgcattggtctgtttatgtacgatcatctgggtaaacgcaccagcttgccgggatcaactggtttgcgttttggcgcaaattcagtgttaaaaccggaaattaagcgcggattcgaatattctgactgttgggtagacgacgcccgtctggtactcgccaacgcccagatggtggtgcgtaaaggcggcgaagtgcttactcggactcgcgccacctctgctcgccgcgaaaacggcctgtggattgtggaagcggaagatatcgataccggcaaaaaatatagctggcaagcgcgcggcttggttaacgccaccggcccgtgggtgaaacagttcttcgacgacgggatgcatctgccttcgccttatggcattcgcctgatcaaaggcagccatattgtggtgccgcgcgtgcatacccagaagcaagcctacattctgcaaaacgaagataaacgtattgtgttcgtgatcccgtggatggacgagttttccatcatcggcactaccgatgtcgagtacaaaggcgatccgaaagcggtgaagattgaagagagtgaaatcaattacctgctgaatgtgtataacacgcactttaaaaagcagttaagccgtgacgatatcgtctggacctactccggtgtgcgtccgctgtgtgatgatgagtccgactcgccgcaggctattacccgtgattacacccttgatattcatgatgaaaatggcaaagcaccgctgctgtcggtattcggcggtaagctgaccacctaccgaaaactggcggaacatgcgctggaaaaactaacgccgtattatcagggtattggcccggcatggacgaaagagagtgtgctaccgggtggcgccattgaaggcgaccgcgacgattatgccgctcgcctgcgccgccgctatccgttcctgactgaatcgctggcgcgtcattacgctcgcacttacggcagcaacagcgagctgctgctcggcaatgcgggaacggtaagcgatctcggggaagatttcggtcatgagttctacgaagcggagctgaaatacctggtggatcacgaatgggtccgccgcgccgacgacgccctgtggcgtcgcacaaaacaaggcatgtggctaaatgcggatcaacaatctcgtgtgagtcagtggctggtggagtatacgcagcagaggttatcgctggcgtcgtaa

SEQ ID NO: 47271 - DNA, 2448 bp, Escherichia coli
atgaatgctccgtttacatattcatcgcccacgcttagcgtagaagctcttaagcactctatcgcttacaagctgatgtttacgattggaaaggacccggtcgtcgccaataaacatgaatggctgaacgcaacgttatttgctgtgcgcgatcgtctcgtggagcgctggttacgttcaaaccgtgcccagttgtcgcaagaaactcgtcaggtttactacctgtcgatggagtttttgattggccgtacgctctccaacgccatgttgtcgctaggaatttacgaagatgtacagggcgcactggaagcgatggggttaaatctcgaagagctgattgatgaagaaaatgacccaggcctcggtaacggtggcctgggacgtctggcggcttgcttccttgattctctggcgacgttagggttgccggggcgcggttacggcatccgctatgactacggtatgttcaagcagaacatcgttaacggtagccagaaagagtcgccagactactggctggaatacggtaacccgtgggaattcaaacgccacaacacgcgctataaagtccgttttggcggtcgcattcagcaggaaggtaaaaaaacgcgctggattgaaaccgaagagattctgggagtcgcttacgatcagataatccctggttacgacaccgacgcgaccaacacgctgcgtttgtggagtgcgcaagccagtagcgaaattaacctcggtaaattcaaccagggtgactacttcgcggcagtggaagataaaaaccactccgagaacgtatctcgcgtactgtatccggatgactccacctactccgggcgtgagctgcgcctgcgtcaggaatacttcctggtttcctcgaccattcaggacattttaagccgccattatcagttgcataaaacctacgataacctggcggataaaatcgcgattcatctcaatgatacccatccggtactgtcgattcctgagatgatgcgtctgctgatcgatgagcaccaatttagctgggacgacgcgtttgaggtgtgttgtcaggtcttctcctacactaaccacacgctgatgagcgaggcgctggaaacctggccggttgatatgctgggtaaaattctgccgcgtcacctgcagatcatctttgaaatcaacgactatttcctgaaaaccttgcaggaacagtatccgaacgataccgatctgctgggacgggcgtcgatcattgatgaatccaacggtcgtcgtgtgcgtatggcctggctggcggttgttgtgagccacaaagttaacggtgtatcggaactgcactctaatctgatggtgcaatcgttgtttgccgactttgcgaaaatcttcccgggtcgtttcaccaacgtcaccaacggtgtgacgccgcgtcgctggctggcggtagcgaacccatcgctttcagccgtgctggacgaacacctgggccgtaactggcgcaccgaccttagcctgcttaatgagctgcaacaacactgtgatttcccaatggttaatcacgctgtgcatcaggcgaagctggagaacaaaaagcgtctggcagagtatatcgcccagcagctgaatgtggtggtgaatccaaaggcgttgttcgatgtacaaatcaaacgtattcacgaatacaaacgtcaattgatgaatgtgttgcatgtgattacccgctataaccgcatcaaggccgacccggatgcgaagtgggtaccgcgcgtgaatatttttggcggtaaggcggcttcggcctattacatggcgaagcacattattcatttgatcaatgacgtagcgaaagtgatcaacaacgatccgcagattggcgataagctgaaagtcgtgttcatcccgaactacagcgttagcctggcgcagttgatcattccggcggcagatctgtctgaacagatttcgctggcagggacggaagcttccggcaccagtaacatgaagtttgcgcttaacggtgcgctgactatcggtacgttggacggtgcgaatgtcgagatgctggatcatgtcggtgctgacaatatctttatttttggtaacacagcggaagaagtggaagaactgcgtcgtcagggctacaaaccgcgtgaatactacgagaaagatgaggagctgcatcaggtgctgacgcaaatcggcagcggtgtattcagtccggaagatccgggtcgctatcgcgatctggttgattcgctgatcaacttcggcgatcactaccaggtactggcggattatcgcagctatgtcgattgtcaggataaagtcgatgaactctacgagcttcaggaagagtggaccgcaaaagcgatgctgaacattgccaatatgggctacttctcttctgaccgtactatcaaagagtacgccgatcatatctggcatatcgatccggtgagattgtaa

SEQ ID NO: 47272 - DNA, 1434 bp, Escherichia coli
atgcaggttttacatgtatgttcagagatgttcccgctgcttaaaaccggcggtctggctgatgttattggggcattacccgcagcacaaatcgcagacggcgttgacgctcgcgtactgttgcctgcatttcccgatattcgccgtggcgtgaccgatgcgcaggtagtatcccgtcgtgataccttcgccggacatatcacgctgttgttcggtcattacaacggggttggcatttacctgattgacgcgccgcatctctatgatcgtccgggaagcccgtatcacgataccaacttatttgcctataccgacaacgtattgcgttttgcgctgctggggtgggttggggcagaaatggccagcgggcttgacccattctggcgtcctgatgtggtgcatgcgcacgactggcatgcaggccttgcgcctgcgtatctggcggcgcgcgggcgtccggcgaagtcggtgtttactgtgcacaacctggcctatcaaggcatgttttatgcacatcacatgaatgacatccaattgccatggtcattctttaatattcatgggctggaattcaacggacaaatctctttcctgaaggccggtctgtactatgccgatcacattacggcggtcagtccaacctacgctcgcgagatcaccgaaccgcagtttgcctacggtatggaaggtctgttgcaacagcgtcaccgtgaagggcgtctttccggcgtactgaacggcgtggacgagaaaatctggagtccagagacggacttactgttggcctcgcgttacacccgcgatacgttggaagataaagcggaaaataagcgccagttacaaatcgcaatggggcttaaggttgacgataaagtgccgctttttgcagtggtgagccgtctgaccagccagaaaggtctcgacctggtgctggaagccttaccgggtcttctggagcagggcgggcagctggcgctactcggcgcgggcgatccggtgctgcaggaaggtttccttgcggcggcagcggaataccccggtcaggtgggcgttcagattggctatcacgaagcattttcgcatcgcattatgggcggcgcggacgtcattctggtgcccagccgttttgaaccgtgcggcttaacgcaactttatggattgaagtacggtacgctgccgttagtgcggcgcaccggtgggcttgctgatacggtttctgactgttctcttgagaaccttgcagatggcgtcgccagtgggtttgtctttgaagatagtaatgcctggtcgctgttacgggctattcgacgtgcttttgtactgtggtcccgtccttcactgtggcggtttgtgcaacgtcaggctatggcaatggattttagctggcaggtcgcggcgaagtcgtaccgtgagctttactatcgcttgaaatag

SEQ ID NO: 47273 - DNA, 1296 bp, Escherichia coli
atggttagtttagagaagaacgatcacttaatgttggcgcgccagctgccattgaaatctgttgccctgatactggcgggaggacgtggtacccgcctgaaggatttaaccaataagcgagcaaaaccggccgtacacttcggcggtaagttccgcattatcgactttgcgctgtctaactgcatcaactccgggatccgtcgtatgggcgtgatcacccagtaccagtcccacactctggtgcagcacattcagcgcggctggtcattcttcaatgaagaaatgaacgagtttgtcgatctgctgccagcacagcagagaatgaaaggggaaaactggtatcgcggcaccgcagatgcggtcacccaaaacctcgacattatccgccgttataaagcggaatacgtggtgatcctggcgggcgaccatatctacaagcaagactactcgcgtatgcttatcgatcacgtcgaaaaaggcgcacgttgcaccgttgcttgtatgccagtaccgattgaagaagcctccgcatttggcgttatggcggttgatgagaacgataaaattatcgaattcgttgaaaaacctgctaacccgccgtcaatgccgaacgatccgagcaaatctctggcgagtatgggtatctacgtctttgacgccgactatctgtatgaactgctggaagaagacgatcgcgatgagaactccagccacgactttggcaaagatttgattcccaagatcaccgaagccggtctggcctatgcgcacccgttcccgctctcttgcgtacaatccgacccggatgccgagccgtactggcgcgatgtgggtacgctggaagcttactggaaagcgaacctcgatctggcctctgtggtgccggaactggatatgtacgatcgcaattggccaattcgcacctacaatgaatcattaccgccagcgaaattcgtgcaggatcgctccggtagccacgggatgacccttaactcactggtttccggcggttgtgtgatctccggttcggtggtggtgcagtccgttctgttctcgcgcgttcgcgtgaattcattctgcaacattgattccgccgtattgttaccggaagtatgggtaggtcgctcgtgccgtctgcgccgctgcgtcatcgatcgtgcttgtgttattccggaaggcatggtgattggtgaaaacgcagaggaagatgcacgtcgtttctatcgttcagaagaaggcatcgtgctggtaacgcgcgaaatgctacggaagttagggcataaacaggagcgataa

SEQ ID NO: 47274 - DNA, 1974 bp, Escherichia coli
atgacacaactcgccattggcaaacccgctcccctcggcgcgcattacgacggtcagggcgtcaacttcacacttttctccgctcatgccgagcgggtagaactgtgtgtctttgacgccaatggccaggaacatcgctatgacttgccagggcacagtggcgacatttggcacggttatctgccggatgcgcgcccgggtttgcgttatggttatcgcgttcatggcccctggcaacccgccgaggggcatcgctttaacccggcgaagttgttgattgatccttgcgcgcggcaaattgacggggagtttaaagataacccgctgctgcacgccggtcataatgaacctgactatcgcgacaacgccgccattgcgccgaaatgcgtagtggtggttgatcactatgactgggaagatgatgccccgccgcgcacgccgtggggcagcaccatcatttatgaagcccatgtcaaaggattaacgtacttgcacccggagatcccggtcgagatccgtggcacttataaagccctcgggcatccggtgatgatcaactatttgaaacaattgggcattaccgcgctggaactgctgccagtggcgcagtttgccagtgaaccacgtctgcaacgcatggggctaagtaactactggggttacaacccggtggcgatgtttgcgctgcatccggcgtatgcctgctcgccagaaacggcgctggatgagtttcgcgatgcaatcaaagcactgcataaagcgggtatcgaagtcattcttgatatcgtgctcaaccatagtgcggaactggacctcgacggcccgttattctcgctgcgtgggatcgataaccgtagctattattggataagagaagacggcgattatcacaactggaccggttgcggcaacacgctcaatttgagtcatccggcggtggtggattatgccagcgcctgcctgcgttattgggtagaaacctgccacgtcgatggtttccgctttgatctggcggcagtcatgggccgtacgccagagttccgtcaggatgcgccgttgtttaccgctatccagaactgcccggtgctctcgcaggtgaagttaattgctgaaccgtgggatatcgctcctggtggttatcaggtgggaaatttcccgccgctgtttgccgagtggaacgatcatttccgcgatgctgcccgtcgtttctggctacattatgatttgcctctgggggcgtttgccgggcgttttgctgcctccagcgatgtttttaaacgtaatggtcgtctgccgagtgccgcgattaatctcgtcaccgcgcatgacggttttacgcttcgcgactgcgtttgcttcaaccataaacacaatgaagcaaacggagaagaaaatcgcgacgggaccaacaacaattacagtaacaatcatggtaaagaagggttaggcggttctcttgacctggttgaacggcggcgcgacagcattcacgccctgttaacaacgttgttgctctcccagggtacgccgatgttactggccggtgacgaacatggtcacagccagcatggcaataacaatgcctactgtcaggataaccaattaacctggttggactggtcgcaggcaagcagtggtttaaccgcatttaccgccgcgttaatccatctgcgcaagcgcattcccgctttggtggagaatcgctggtgggaagaaggcgacggcaatgtccgttggctaaatcgatatgctcaacctttaagcacggatgagtggcaaaacgggccgaaacagctgcaaattctgctctcggatcgctttttgatcgcaattaacgccacgcttgaggtaacagagattgttttacctgctggggagtggcacgccattcccccattcgctggagaggataacccagtgattacggctgtctggcagggacctgcacacggattgtgtgtgttccagagatga

SEQ ID NO: 47275 - DNA, 2187 bp, Escherichia coli
atgtccgatcgtatcgatagagacgtgattaacgcgctaattgcaggccattttgcggatcctttttccgtactgggaatgcataaaaccaccgcgggactggaagtccgtgcccttttacccgacgctaccgatgtgtgggtgattgaaccgaaaaccgggcgcaaactcgcaaaactggagtgtctcgactcacggggattctttagcggcgtcattccgcgacgtaagaattttttccgctatcagttggctgttgtctggcatggtcagcaaaacctgattgatgatccttaccgttttggtccgctaatccaggaaatggatgcctggctattatctgaaggtactcacctgcgcccgtatgaaaccttaggcgcgcatgcagatactatggatggcgtcacaggtacgcgtttctctgtctgggctccaaacgcccgtcgggtctcggtggttgggcaattcaactactgggacggtcgccgtcacccgatgcgcctgcgtaaagagagcggcatctgggaactgtttatccctggggcgcataacggtcagctctataaatacgagatgattgatgccaatggcaacttgcgtctgaagtccgacccttatgcctttgaagcgcaaatgcgcccggaaaccgcgtctcttatttgcgggctgccggaaaaggttgtacagactgaagagcgcaaaaaagcgaatcagtttgatgcgccaatctctatttatgaagttcacctgggttcctggcgtcgccacaccgacaacaatttctggttgagctaccgcgagctggccgatcaactggtgccttatgctaaatggatgggctttacccacctcgaactactgcccattaacgagcatcccttcgatggcagttggggttatcagccaaccggcctgtatgcgccaacccgccgttttggtactcgcgacgacttccgttatttcattgatgccgcacacgcagctggtctgaacgtgattctcgactgggtgccaggccacttcccgactgatgactttgcgcttgccgaatttgatggcacgaacttgtatgaacacagcgatccgcgtgaaggctatcatcaggactggaacacgctgatctacaactatggtcgccgtgaagtcagtaacttcctcgtcggtaacgcgctttactggattgaacgttttggtattgatgcgctgcgcgtcgatgcggtggcgtcaatgatttatcgcgactacagccgtaaagagggggagtggatcccgaacgaatttggcgggcgcgagaatcttgaagcgattgaattcttgcgtaataccaaccgtattcttggtgagcaggtttccggtgcggtgacaatggctgaggagtctaccgatttccctggcgtttctcgtccgcaggatatgggcggtctgggcttctggtacaagtggaacctcggctggatgcatgacaccctggactacatgaagctcgacccggtttatcgtcagtatcatcacgataaactgaccttcgggattctctacaactacactgaaaacttcgtcctgccgttgtcgcatgatgaagtggtccacggtaaaaaatcgattctcgaccgcatgccgggcgacgcatggcagaaattcgcgaacctgcgcgcctactatggctggatgtgggcattcccgggcaagaaactactgttcatgggtaacgaatttgcccagggccgcgagtggaaccatgacgccagcctcgactggcatctgttggaaggcggcgataactggcaccacggtgtccagcgtctggtgcgcgatctgaacctcacctaccgccaccataaagcaatgcatgaactggattttgacccgtacggctttgaatggctggtggtggatgacaaagaacgctcggtgctgatctttgtgcgtcgcgataaagagggtaacgaaatcatcgttgccagtaactttacgccggtaccgcgtcatgattatcgcttcggcataaaccagccgggcaaatggcgtgaaatcctcaataccgattccatgcactatcacggcagtaatgcaggcaatggcggcacggtacacagcgatgagattgccagccacggtcgtcagcattcactaagcctgacgctaccaccgctggccactatctggctggttcgggaggcagaatga

SEQ ID NO: 47276 - DNA, 1104 bp, Escherichia coli
atgaaaaatgttggttttatcggctggcgcggtatggtcggctccgttctcatgcaacgcatggttgaagagcgcgacttcgacgccattcgccctgtcttcttttctacttctcagcttggccaggctgcgccgtcttttggcggaaccactggcacacttcaggatgcctttgatctggaggcgctaaaggccctcgatatcattgtgacctgtcagggcggcgattataccaacgaaatctatccaaagcttcgtgaaagcggatggcaaggttactggattgacgcagcatcgtctctgcgcatgaaagatgacgccatcatcattcttgaccccgtcaatcaggacgtcattaccgacggattaaataatggcatcaggacttttgttggcggtaactgtaccgtaagcctgatgttgatgtcgttgggtggtttattcgccaatgatcttgttgattgggtgtccgttgcaacctaccaggccgcttccggcggtggtgcgcgacatatgcgtgagttattaacccagatgggccatctgtatggccatgtggcagatgaactcgcgaccccgtcctctgctattctcgatatcgaacgcaaagtcacaaccttaacccgtagcggtgagctgccggtggataactttggcgtgccgctggcgggtagcctgattccgtggatcgacaaacagctcgataacggtcagagccgcgaagagtggaaagggcaggcggaaaccaacaagatcctcaacacatcttccgtaattccggtagatggtttatgtgtgcgtgtcggggcattgcgctgccacagccaggcattcactattaaattgaaaaaagatgtgtctattccgaccgtggaagaactgctggctgcgcacaatccgtgggcgaaagtcgttccgaacgatcgggaaatcactatgcgtgagctaaccccagctgccgttaccggcacgctgaccacgccggtaggccgcctgcgtaagctgaatatgggaccagagttcctgtcagcctttaccgtgggcgaccagctgctgtggggggccgcggagccgctgcgtcggatgcttcgtcaactggcgtaa

SEQ ID NO: 47277 - DNA, 489 bp, Escherichia coli
atgggcgtatcgggcagcggcaaatctgcggtcgccagtgaagtggcgcatcaacttcatgccgcgtttcttgatggcgatttcctccatccacggcgcaatatcgaaaaaatggcgtctggcgaaccactgaatgacgacgatcgcaaaccgtggttgcaggcgctgaacgacgccgcgtttgctatgcagcgcactaataaagtgtcgctgatcgtctgttctgcattgaaaaaacactatcgcgacttgctgcgtgaaggtaatccgaatctctctttcatctatttgaaaggcgattttgatgtgattgaaagccgcctgaaagcgcgcaaaggccatttctttaaaacccaaatgttggtgacgcagtttgaaacgctgcaggagccgggtgcggacgaaaccgatgtactggtggtggatatcgatcaaccgctggaaggtgttgtggcaagcaccattgaggttattaaaaaaggcaaataa

SEQ ID NO: 47278 - DNA, 2199 bp, Escherichia coli
atgtcgactcctgacaatcacggcaagaaagcccctcaatttgctgcgttcaaaccgctaaccacggtacagaacgccaacgactgttgctgcgacggcgcatgttccagcacgccaactctctctgaaaacgtctccggcacccgctatagctggaaagtcagcggcatggactgcgccgcctgtgcgcgcaaggtagaaaatgccgtgcgccagcttgcaggcgtgaatcaggtgcaggtgttgttcgccaccgaaaaactggtggtcgatgccgacaatgacattcgtgcacaagttgaatctgcgctgcaaaaagcaggctattccctgcgcgatgaacaggccgccgaagaaccgcaagcatcacgcctgaaagagaatctgccgctgattacgctaatcgtgatgatggcaatcagctggggtctggagcagttcaatcatccgttcgggcaactggcgtttatcgcgaccacgctggttgggctgtacccgattgctcgtcaggcattacggttgatcaaatccggcagctacttcgccattgaaaccttaatgagcgtagccgctattggtgcactgtttattggcgcaacggctgaagctgcgatggtgttgctgctgtttttgattggtgaacgactggaaggctgggccgccagccgcgcgcgtcagggcgttagcgcgttaatggcgctgaaaccagaaaccgccacgcgcctgcgtaagggtgagcgggaagaggtggcgattaacagcctgcgccctggcgatgtgattgaagtcgccgcaggtgggcgtttgcctgccgacggtaaactgctctcaccgtttgccagttttgatgaaagcgccctgaccggcgaatccattccggtggagcgcgcaacgggcgataaagtccctgctggtgccaccagcgtagaccgtctggtgacgttggaagtgctgtcagaaccgggagccagcgccattgaccggattctgaaactgatcgaagaagccgaagagcgtcgcgctcccattgagcggtttatcgaccgtttcagccgtatctatacgcccgcgattatggccgtcgctctgctggtgacgctggtgccaccgctgctgtttgccgccagctggcaggagtggatttataaagggctgacgctgctgctgattggctgcccgtgtgcgttagttatctcaacgcctgcggcgattacctccgggctggcggcggcagcgcgtcgtggggcgttgattaaaggcggagcggcgctggaacagctgggtcgtgttactcaggtggcgtttgataaaaccggtacgctgaccgtcggtaaaccgcgcgttaccgcgattcatccggcaacgggtattagtgaatctgaactgctgacactggcggcggcggtcgagcaaggcgcgacgcatccactggcgcaagccatcgtacgcgaagcacaggttgctgaactcgccattcccaccgccgaatcacagcgggcgctggtcgggtctggcattgaagcgcaggttaacggtgagcgcgtattgatttgcgctgccgggaaacatcccgctgatgcatttactggtttaattaacgaactggaaagcgccgggcaaacggtagtgctggtagtacgtaacgatgacgtgcttggtgtcattgcgttacaggataccctgcgcgccgatgctgcaactgccatcagtgaactgaacgcgctgggcgtcaaaggggtgatcctcaccggcgataatccacgcgcagcggcggcaattgccggggagctggggctggagtttaaagcgggcctgttgccggaagataaagtcaaagcggtgaccgagctgaatcaacatgcgccgctggcgatggtcggtgacggtattaacgacgcgccagcgatgaaagctgccgccatcgggattgcaatgggtagcggcacagacgtggcgctggaaaccgccgacgcagcattaacccataaccacctgcgcggcctggtgcaaatgattgaactggcacgcgccactcacgccaatatccgccagaacatcactattgcgctggggctgaaagggatcttcctcgtcaccacgctgttagggatgaccgggttgtggctggcagtgctggcagatacgggggcgacggtgctggtgacagcgaatgcgttaagattgttgcgcaggagataa

SEQ ID NO: 47279 - DNA, 2685 bp, Escherichia coli
gtgagccagcattatggaaaaaccgttgcgctgaacaatatcactctcgatattccggcccgctgtatggtcgggctgattggcccggacggcgtcgggaagtcgagcttgttgtcgttgatttccggtgcccgcgtcattgaacagggcaatgtgatggtgctgggcggcgatatgcgcgacccgaagcatcgccgcgacgtctgcccgcgcatcgcctggatgccgcaggggctgggcaaaaacctctaccacaccttgtcggtgtatgaaaacgtcgattttttcgctcgcctgttcggtcacgacaaagcggagcgggaagtgcgaatcaatgagctgctgaccagcaccgggttagcaccgtttcgcgatcgtccggcagggaaactctccggcgggatgaagcaaaaacttgggctgtgctgcgcgttaatccacgacccggaactgttgatccttgatgagccaacaacgggggttgacccgctctcccgctcccagttctgggatctgatcgacagtattcgccagcggcagagcaatatgagcgtgctggtcgccaccgcctatatggaagaggccgaacgcttcgactggctggtagcgatgaatgccggagaagtgctggcaactggcagcgccgaagagctacggcagcaaacgcaaagcgctacgctggaagaagcatttataaatctgttaccgcaagcgcaacgccaggcgcatcaggcggtagtgatcccaccgtatcaacctgaaaacgcagagattgccatcgaagcgcgcgatctgaccatgcgttttggttccttcgttgccgttgatcacgttaatttccgcattccacgcggggagatttttggttttcttggttcgaacggctgcggtaaatccaccaccatgaaaatgctcaccggactgctgcccgccagcgaaggtgaggcgtggctgttcgggcaaccggttgatccaaaagatatcgatacccgccgtcgggtgggctatatgtcgcaggcgttttcgctctataacgaactcaccgtgcggcaaaaccttgagttacatgcccgtttgtttcacatcccggaagcggaaattcccgcaagagtggctgaaatgagcgagcgttttaagctcaacgacgttgaagatattctgccggagtcattgccgctcggcattcgccagcggctttcgctggcggtggcggtgattcatcgcccggagatgttaatcctcgatgagcctacttctggtgtcgatccggtggcgagggatatgttctggcagttgatggtcgatctctcgcgccaggacaaagtgactatcttcatctccacccactttatgaacgaagcggaacgttgcgaccgcatctcactgatgcacgccggaaaagtgcttgccagcggtacaccgcaggaactggttgagaaacgcggagccgccagtctggaagaggcatttatcgcctatttgcaggaagcggcagggcagagcaacgaagccgaagcgccgcccgtggtacacgacaccacccacgcgccgcgtcagggatttagcctgcgccgtctgtttagctacagccgccgcgaagcgctggaactgcgacgcgatccagtacgttcgacgctggcgctgatgggaacggtgatcctgatgctgataatgggttacggcatcagtatggatgtggaaaacctgcgctttgcggtgctcgaccgcgaccagaccgtcagtagccaggcgtggacactcaacctctccggttcccgttactttatcgaacagccgccgctcaccagttatgacgagcttgatcgtcggatgcgtgcgggcgatatcacggtggcgattgagatcccgcccaatttcgggcgcgatatcgcgcgtggtacgcctgtggaactcggcgtctggatcgacggagcgatgccgagccgtgctgaaacggtaaaaggttacgtgcaggccatgcaccagagctggttacaggatgtggcgagccgacaatcgacacccgccagccaaagcgggctgatgaatattgagacgcgctatcgctataacccggacgtaaaaagcctgccagcgattgttccggcggtgatcccgcttctgctgatgatgatcccgtcaatgctaagcgcccttagcgtggtgcgggaaaaagagcttgggtcgattatcaacctttacgtgacccccaccacgcgtagtgaatttttgcttggtaaacagttgccatacatcgcgctggggatgctgaactttttcctgctctgcggcctgtcggtgtttgtgtttggcgtaccgcataaaggcagtttcctgacgctcaccctggcggcgctgctgtatatcatcattgccaccggaatggggctgctgatctccacctttatgaaaagccagattgccgccattttcggaacggcgattatcacgttgatcccggcgacacagttttccgggatgatcgatccggtagcttcgctggaagggcctggacgttggatcggcgaggtttacccgaccagtcattttctgactatcgcccgcgggacgttctcgaaagcgctggatctgactgatttgtggcaactttttatcccgttactgatagccatcccgctggtgatgggcttaagtatcctgctgctgaaaaaacaggagggatga

SEQ ID NO: 47280 - DNA, 2043 bp, Escherichia coli
atgacgaatccgttactgactccctttgaattgcctccgttttctaaaattctcccggaacatgtcgttccagccgtgactaaggcattgaacgactgccgcgaaaacgtggagcgcgtagtagcgcaaggggcaccgtacacctgggaaaatctctgccagccgctggcggaagtggacgatgtgttggggcgtatcttctccccggtcagccacctgaactcggtgaaaaatagcccggaactgcgtgaagcctacgaacaaaccctgccgctgctgtcggaatacagcacctgggtagggcaacatgaagggctgtataaagcgtatcgcgacctgcgcgatggcgatcattacgccacgctgaacacggcgcagaagaaagcggttgataacgcactgcgcgactttgaactctctggcataggtctgccgaaagagaaacagcagcgttacggcgaaattgcgacccgtctttctgaactgggcaaccagtacagcaacaacgtcctcgatgcgacaatgggctggaccaaactcgttaccgacgaagcggagctggcggggatgccagaaagcgcgctggctgcggcaaaagcccaggccgaagcgaaagagctggaaggttatttgctgacgctggatatcccaagctacttgccggtaatgacctactgcgacaaccaggctctgcgtgaagagatgtatcgcgcttacagcacccgcgcctccgatcaaggcccaaacgccggtaaatgggataacagcaaggtgatggaagagatcctcgcgctgcgtcacgaactggcgcaactgctgggctttgaaaactacgcctttaaatcccttgccactaaaatggcagaaaacccgcagcaggtgctggatttcttaaccgatctggcaaaacgcgcgcgtccacaaggcgaaaaagagctggcgcaattgcgtgcctttgccaaagccgaatttggcgtcgatgagttgcagccgtgggatatcgcttactacagcgaaaaacaaaaacagcacctctacagcatcagtgacgaacagctgcgtccgtacttcccggaaaacaaagcggttaacggcctgtttgaagtggttaagcgtatttacggcatcaccgctaaagagcgtaaagatgttgatgtctggcatccggatgtacgtttcttcgaactgtatgacgaaaataacgaactgcgcggtagcttctacctcgatctgtatgcccgtgaaaacaagcgcggcggggcgtggatggatgactgcgtaggccagatgcgtaaagctgatggttctttgcaaaaaccggtcgcgtatttgacttgtaacttcaaccgcccggtaaatggtaaaccggcgctgttcactcacgacgaagtgatcaccctcttccacgagttcggtcacggcctgcaccatatgctgacccgcatcgaaaccgctggtgtttccggtatcagcggtgtgccgtgggatgcggtcgaactgccgagtcagtttatggaaaactggtgctgggagccggaggcgctggcgtttatctctggtcactatgaaaccggcgaaccgctgccgaaagagttgctggataaaatgctggcggcgaagaactaccaggcggcgctgtttattctgcgtcagctggagttcggcctgtttgatttccgccttcatgccgagttccgcccggatcagggggcaaaaatcctcgaaactctggcagaaatcaagaaactggttgccgtggtgccatctccgtcctggggccgtttcccgcacgctttcagccatattttcgccggtggttatgccgcaggttactacagctacctgtgggctgacgtactggcggcagatgctttctcgcgctttgaggaagagggcattttcaaccgtgaaaccgggcagtcgttcctcgacaacattctgagccgtggcggttcagaagagccgatggatctgttcaaacgcttccgtggtcgtgaaccgcagctggatgcgatgctggagcattacggcattaagggctga

SEQ ID NO: 47281 - DNA, 1650 bp, Escherichia coli
atgctcaatcagaaaattcaaaaccctaatccagacgaactgatgatcgaagtcgatctctgctatgagctggacccgtatgaattaaaactggatgagatgatcgaggcagaaccggaacccgagatgattgaagggctgcctgcctctgatgcgctgacgcctgccgatcgctatctcgaactgttcgagcatgttcagtcggcgaaaattttccccgacagtaaaacctttcccgactgcgcacctaaaatggacccgctggatatcttaatccgctaccgtaaagtgcgccgtcatcgtgattttgacttgcgcaagtttgttgaaaaccacttctggctgccggaggtctactccagcgagtatgtatcggacccgcaaaattccctgaaagagcatatcgaccagctgtggccggtgctaacccgcgaaccacaggatcacattccgtggtcttctctgctggcgctgccgcagtcatatattgtcccgggcggccgttttagcgaaacctactattgggattcctatttcaccatgctggggctggcggaaagtggtcgggaagatttgctgaaatgcatggccgataacttcgcctggatgatcgaaaactacggtcacatccccaacggcaaccgcacctattatttgagccgctcgcaaccaccggtttttgcgctgatggtggagttgtttgaagaagatggtgtacgcggtgcgcgccgctatctcgaccaccttaaaatggaatatgccttctggatggacggtgcagaatcgttaatccctaatcaggcctatcgccatgttgtgcggatgccggacggatcgctgctcaaccgttactgggacgatcgcgacacgccgcgtgacgaatcctggcttgaggacgttgaaaccgcgaaacattctggtcgcccgcccaacgaggtgtaccgcgatttacgcgcgggggcggcctccggttgggattactcttcccgttggctgcgtgatactggtcgtctggcgagcattcgtaccacccagttcatccccatcgatctgaatgccttcctgtttaaactggagagcgccatcgccaacatctcggcgctgaaaggcgagaaagagacagaagcactgttccgccagaaagccagtgcccgtcgcgatgcggtaaaccgttacctctgggatgatgaaaacggcatctaccgcgattacgactggcgacgcgaacaactggcgctgttttccgctgccgccattgtgccactctatgtcggtatggcgaaccatgaacaggccgatcgtctggcaaacgccgtgcgcagtcggttactgacacctggcgggattctggcaagcgagtacgaaaccggtgaacagtgggataaacccaacggctgggcaccgttacaatggatggcgattcagggatttaaaatgtacggcgatgaccttctgggtgatgaaatcgcgcgaagctggctgaagacggtgaatcagttctatctggaacagcacaaactgatcgaaaaataccatattgccgatggtgttccccgcgaaggcggcggtggcgagtatccgttgcaggatgggtttggctggactaacggtgtggtacgccgtttaattggtttgtacggcgaaccataa

SEQ ID NO: 47282 - DNA, 1287 bp, Escherichia coli
atgaaaacctctctgtttaaaagcctttactttcaggtcctgacagcgatagccattggtattctccttggccatttctatcctgaaataggcgagcaaatgaaaccgcttggcgacggcttcgttaagctcattaagatgatcatcgctcctgtcatcttttgtaccgtcgtaacgggcattgcgggcatggaaagcatgaaggcggtcggtcgtaccggcgcagtcgcactgctttactttgaaattgtcagtaccatcgcgctgattattggtcttatcatcgttaacgtcgtgcagcctggtgccggaatgaacgtcgatccggcaacgcttgatgcgaaagcggtagcggtttacgccgatcaggcgaaagaccagggcattgtcgccttcattatggatgtcatcccggcgagcgtcattggcgcatttgccagcggtaacattctgcaggtgctgctgtttgccgtactgtttggttttgcgctccaccgtctgggcagcaaaggccaactgatttttaacgtcatcgaaagtttctcgcaggtcatcttcggcatcatcaatatgatcatgcgtctggcacctattggtgcgttcggggcaatggcgtttaccatcggtaaatacggcgtcggcacactggtgcaactggggcagctgattatctgtttctacattacctgtatcctgtttgtggtgctggtattgggttcaatcgctaaagcgactggtttcagtatcttcaaatttatccgctacatccgtgaagaactgctgattgtactggggacttcatcttccgagtcggcgctgccgcgtatgctcgacaagatggagaaactcggctgccgtaaatcggtggtggggctggtcatcccgacaggctactcgtttaaccttgatggcacatcgatatacctgacaatggcggcggtgtttatcgcccaggccactaacagtcagatggatatcgtccaccaaatcacgctgttaatcgtgttgctgctttcttctaaaggggcggcaggggtaacgggtagtggctttatcgtgctggcggcgacgctctctgcggtgggccatttgccggtagcgggtctggcgctgatcctcggtatcgaccgctttatgtcagaagctcgtgcgctgactaacctggtcggtaacggcgtagcgaccattgtcgttgctaagtgggtgaaagaactggaccacaaaaaactggacgatgtgctgaataatcgtgcgccggatggcaaaacgcacgaattatcctcttaa

SEQ ID NO: 47283 - DNA, 1107 bp, Escherichia coli
atgaatgtgttgcgtagtggaatcgtgacgatgctgctgctggctgcctttagtgttcaggcagcctgtacctggcctgcctgggagcagtttaaaaaggattacatcagtcaggaagggcgcgtcatcgaccccagcgacgcgcgcaaaatcaccacctccgaagggcaaagttacggcatgttctctgccctggcggctaacgaccgtgcagctttcgataatattctcgactggacgcagaacaatctcgctcagggttctttaaaagaacgtttgcccgcctggctgtggggcaagaaagagaacagtaagtgggaagtgctggacagcaattcggcctccgatggtgatgtctggatggcctggtcgttgctggaggcggggcgtttgtggaaagagcagcgttataccgacatcggcagcgcgttgctaaaacgtatcgcgcgggaggaagtggtgacggtgcctgggctgggttccatgttgttaccgggcaaagtgggttttgctgaggataacagctggcgttttaaccccagctacctgccgccgacgctggcgcagtatttcacccgctttggcgcgccgtggaccacgctgcgcgaaaccaatcaacgtttattgctggaaaccgccccgaaaggtttttcgccagactgggtgcgctatgagaaagacaaaggctggcagctaaaagccgaaaaaacattgatcagcagctacgacgctatccgcgtttacatgtgggtaggcatgatgcctgacagcgatccgcaaaaagcgcggatgctcaaccggtttaaaccgatggcgacattcactgagaaaaacggttatccgccggaaaaagtggatgtggctacggggaaagcgcagggtaaaggaccagtcggtttttctgccgccatgctgccctttttacaaaaccgcgatgcgcaggccgttcagcgccagcgcgtggccgataactttcccggcagcgatgcctattacaactatgtgctgaccctgtttggacaaggctgggatcaacaccgtttccgcttctcgacaaaaggtgagttattacctgactggggccaggaatgcgcaaattcacactaa

SEQ ID NO: 47284 - DNA, 2220 bp, Escherichia coli
atggaaaactccttgcagagcgcggttcgcgaccaggttcacagcaatacgcgggtacgatttccaatggtgcgaaaaggctttcttgcgtcaccggaaaacccgcaaggcattcgtgggcaggatgaatttgttcgcgtgagttgggatgaggcgctggatcttattcaccaacaacataaacgcattcgtgaggcttatggtccggcatcgatttttgctggttcctacggctggcgttcaaacggcgtgctgcataaggcctcgacattattacaacgctatatggcgctggcaggcggttataccgggcatctgggggattattcgaccggcgcggcacaggcgatcatgccgtatgtcgtgggtggtagtgaagtttatcaacagcagaccagttggccgctggtgctggaacatagcgatgtcgtggtgctgtggagtgctaacccactcaatacgctgaaaattgcgtggaatgcatccgatgagcaggggctttcttacttttctgcactgcgtgacagcgggaaaaagctgatctgcattgatccaatgcgatcggaaaccgtcgatttctttggcgataaaatggagtgggtggcaccgcacatgggcaccgatgttgcgctgatgctggggatcgcccatacgctggtggaaaatggttggcacgacgaagcgtttctggcgcgttgcaccacaggttatgccgtcttcgcctcttatttgctgggcgagagtgacggaatagcgaaaaccgccgaatgggcagcagagatttgtggtgttggcgcagcgaaaatccgcgagctggcggctattttccaccaaaataccaccatgctgatggcaggctggggaatgcagcgccaacagtttggtgagcaaaaacactggatgatcgtcacgctggcagcaatgttggggcaaatcggcacacccggcggcggttttggtctttcttaccattttgccaatggtggtaaccccacgcggcgttctgcggtgctctcttccatgcagggcagcttgccgggtggctgcgatgcggtggataaaatccctgttgcccgcattgttgaagcactggaaaaccctggtggcgcatatcaacacaacggtatgaaccgacatttcccggatattcgttttatctggtgggcgggcggtgccaactttactcatcatcaggataccaatcgcctgatccgtgcctggcaaaaaccggagctggtggtgatctctgaatgcttctggacggcggcggcaaaacacgcggatatcgttctgcctgcgactacctcttttgagcgtaatgatctcaccatgaccggtgattacagtaatcagcatctggtgccgatgaagcaagtggtgccgccacgctatgaagcgcgtaatgattttgatgtttttgccgagttaagtgaacgctgggagaagggcggttatgcacgttttacggaaggaaaaagtgagctgcaatggctggaaacgttttataacgttgcccgacagcgcggggcaagccagcaggttgaattgccgccatttgctgagttctggcaagccaaccagttaattgagatgccggaaaacccggacagcgagcggtttattcgcttcgctgatttttgccgcgatccgctggcgcatccgttaaaaaccgccagcggcaagattgaaatcttctcacagcgtattgccgattacggttacccggattgccctgggcatccaatgtggctggagccggacgaatggcagggcaatgccgaaccagaacagttgcaggtactttctgcccatccggcgcaccgcctgcacagccagctgaattacagttctctgcgcgaattgtacgcggtggcaaatcgtgagcctgtcaccattcatcctgacgatgcccaggagcgcggcatacaagatggcgatactgttcggttgtggaacgcacgcgggcaaattcttgccggagcggtcattagcgagggaattaaacctggcgtgatttgcattcacgaaggggcatggccggatctggatttaaccgctgacggtatttgtaaaaacggcgcagtgaacgtgctgaccaaagatctccccagctcgcggctggggaatggctgtgcgggtaatacggcgctggcatggctggaaaaatacaacggtccggaactgacacttacagcgtttgaaccaccggccagctcataa

SEQ ID NO: 47285 - DNA, 1455 bp, Escherichia coli
atgtatatcgggatagatcttggcacctcgggcgtaaaagttattttgctcaacgagcagggtgaggtggttgctgcgcaaacggaaaagctgaccgtttcgcgcccgcatccactctggtcggaacaagacccggaacagtggtggcaggcaactgatcgcgcaatgaaagctctgggcgatcagcattctctgcaggacgttaaagcattgggtattgccggccagatgcacggagcaaccttgctggatgctcagcaacgggtgttacgccctgccattttgtggaacgacgggcgctgtgcgcaagagtgcactttgctggaagcgcgagttccgcaatcgcgggtgattaccggcaacctgatgatgcccggatttactgcgcctaaattgctatgggttcagcggcatgagccggagatattccgtcaaatcgacaaagtattattaccgaaagattacttgcgtctgcgtatgacgggggagtttgccagcgatatgtctgacgcagctggcaccatgtggctggatgtcgcaaagcgtgactggagtgacgtcatgctgcaggcttgcgacttatctcgtgaccagatgcccgcattatacgaaggcagcgaaattactggtgctttgttacctgaagttgcgaaagcgtggggtatggcgacggtgccagttgtcgcaggcggtggcgacaatgcagctggtgcagttggtgtgggaatggttgatgctaatcaggcaatgttatcgctggggacgtcgggggtctattttgctgtcagcgaagggttcttaagcaagccagaaagcgccgtacatagcttttgccatgcgctaccgcaacgttggcatttaatgtctgtgatgctgagtgcagcgtcgtgtctggattgggccgcgaaattaaccggcctgagcaatgtcccagctttaatcgctgcagctcaacaggctgatgaaagtgccgagccagtttggtttctgccttatctttccggcgagcgtacgccacacaataatccccaggcgaagggggttttctttggtttgactcatcaacatggccccaatgaactggcgcgagcagtgctggaaggcgtgggttatgcgctggcagatggcatggatgtcgtgcatgcctgcggtattaaaccgcaaagtgttacgttgattgggggcggggcgcgtagtgagtactggcgtcagatgctggcggatatcagcggtcagcagctcgattaccgtacggggggggatgtggggccagcactgggcgcagcaaggctggcgcagatcgcggcgaatccagagaaatcgctcattgaattgttgccgcaactaccgttagaacagtcgcatctaccagatgcgcagcgttatgccgcttatcagccacgacgagaaacgttccgtcgcctctatcagcaacttctgccattaatggcgtaa

SEQ ID NO: 47286 - DNA, 2031 bp, Escherichia coli
atgaaactcgccgcctgttttctgacactccttcctggcttcgccgttgccgccagctggacttctccggggtttcccgcctttagcgaacaggggacaggaacatttgtcagccacgcgcagttgcccaaaggtacgcgtccactaacgctaaattttgaccaacagtgctggcagcctgcggatgcgataaaactcaatcagatgctttccctgcaaccttgtagcaacacgccgcctcaatggcgattgttcagggacggcgaatatacgctgcaaatagacacccgctccggtacgccaacattgatgatttccatccagaacgccgccgaaccggtagcaagcctggtccgtgaatgcccgaaatgggatggattaccgctcacagtggatgtcagcgccactttcccggaaggagccgccgtacgggattattacagccagcaaattgcgatagtgaagaacggtcaaataatgttacaacccgctgccaccagcaacggtttactcctgctggaacgggcagaaactgacacatccgcccctttcgactggcataacgccacggtttactttgtgctgacagatcgtttcgaaaacggcgatcccagtaatgaccagagttacggacgtcataaagacggtatggcggaaattggcacttttcacggcggcgatttacgcggcctgaccaacaaactggattacctccagcagttgggcgttaatgctttatggataagcgccccatttgagcaaattcacggctgggtcggcggcggtacaaaaggcgatttcccgcattatgcctaccacggttattacacacaggactggacgaatcttgatgccaatatgggcaacgaagccgatctacggacgctggttgatagcgcacatcagcgcggtattcgtattctctttgatgtcgtgatgaaccacaccggctatgccacgctggcggatatgcaggagtatcagtttggcgcgttatatctttctggtgacgaagtgaaaaaatcgctgggtgaacgctggagcgactggaaacctgccgccgggcaaacctggcatagctttaacgattacattaatttcagcgacaaaacaggctgggataaatggtggggaaaaaactggatcagaacggatatcggcgattacgacaatcctggattcgacgatctcactatgtcgctagcctttttgccggatatcaaaaccgaatcaactaccgcttctggtctgccggtgttctataaaaacaaaatggatacccacgccaaagccattgacggctatacgccgcgcgattacttaacccactggttaagtcagtgggtccgcgactatgggattgatggttttcgggtcgataccgccaaacatgttgagttgcccgcctggcagcaactgaaaaccgaagccagcgccgcgcttcgcgaatggaaaaaagctaaccccgacaaagcattagatgacaaacctttctggatgaccggtgaagcctggggccacggcgtgatgcaaagtgactactatcgccacggcttcgatgcgatgatcaatttcgattatcaggagcaggcggcgaaagcagtcgactgtctggcgcagatggatacgacctggcagcaaatggcggagaaattgcagggtttcaacgtgttgagctacctctcgtcgcatgatacccgcctgttccgtgaagggggcgacaaagcagcagagttattactattagcgccaggcgcggtacaaatcttttatggtgatgaatcctcgcgtccgttcggtcctacaggttctgatccgctgcaaggtacacgttcggatatgaactggcaggatgttagcggtaaatctgccgccagcgtcgcgcactggcagaaaatcagccagttccgcgcccgccatcccgcaattggcgcgggcaaacaaacgacacttttgctgaagcagggctacggctttgttcgtgagcatggcgacgataaagtgctggtcgtctgggcagggcaacagtaa

SEQ ID NO: 47287 - DNA, 999 bp, Escherichia coli
atgaaagtgacatttgagcagttaaaagcagcctttaatcgggtcttaatttcacgcggcgttgacagcgaaacggctgacgcctgtgcagagatgttcgcccgcaccaccgaatccggcgtttattctcacggcgttaatcgtttccctcgtttcattcaacaactggaaaacggcgatatcattcctgatgcccaacccaaacgtataaccagcctcggcgcaattgaacagtgggacgcccagcgttcgatcggtaacctgacagcgaaaaagatgatggatcgcgccattgaactggctgccgatcacggtattggtctggtggcactacgtaatgccaaccactggatgcgcggcggcagctacggctggcaggcggcggaaaaaggctatattggcatttgctggaccaactccatcgccgtaatgccgccgtggggcgcaaaagagtgtcgcataggcactaacccgctgatcgtcgccattccttccacgccgatcaccatggtcgatatgtcgatgtcgatgttctcttacggcatgttagaagttaaccgtctggcaggtcgtcagctcccggtcgatggtggctttgatgatgagggcaatttgaccaaagaacctggcgttatcgagaagaatcgccgcattttgccgatgggctactggaaaggttctggcatgtcgattgtgctggatatgatcgctactctcctttccgacggcgcatccgttgccgaagtcacccaggacaacagcgacgaatacggcatttcacaaatttttattgccattgaagtggacaagcttatcgacggtcccacccgcgatgccaagctgcaacgcatcatggattacgttactagtgccgagcgtgctgacgaaaatcaggccattcgcttacccggccatgaatttactaccctgctggccgaaaaccgccgtaacggcatcactgttgatgacagcgtgtgggccaaaatccaggcgttatga

SEQ ID NO: 47288 - DNA, 1497 bp, Escherichia coli
atgacgcaatactggctggggttagattgtggcggtagctggctgaaagccgggctgtatgaccgcgaaggccgggaggcaggcgtgcagcgcctgccgctgtgcgcattaagcccgcagccaggctgggcagagcgcgatatggcagaactgtggcaatgctgcatggctgtcattcgcgccctgcttactcattctggtgttagcggggaacaaattgtcggtatcggcatctccgcacagggaaagggcttgtttttgctggataaaaacgacaaaccgctcgggaatgctattttgtcctcggaccgccgggcgatggaaatcgttcgtcgctggcaggaagatggcatcccggaaaaactctacccgctgacccgacaaaccttgtggaccgggcatccggtgtcgctgttacgctggctgaaagagcacgaaccagaacgctacgcgcaaattggctgcgtgatgatgacgcacgactacctgcgctggtgtttaactggcgtcaaaggctgtgaagagagcaatatttccgagtccaacctctacaacatgagtcttggggaatatgacccgtgcctcaccgactggctggggatcgctgaaatcaatcacgccctgccgcctgttgtcggatctgccgaaatctgcggggagatcaccgctcagacagccgccctgaccggtctgaaagcgggtacgcccgttgttggcggcctgtttgatgtggtttccaccgcactctgcgccgggatcgaagacgaatttaccctcaatgcggtgatggggacctgggcggtgaccagcggcataacccgcggtttacgtgacggtgaagcgcatccgtatgtctatggtcgctacgttaacgatggtgaatttatcgttcacgaagccagccctacctcttccggcaacctcgaatggtttaccgcacagtggggagaaatctcgtttgatgagatcaatcaggccgttgccagcttgccgaaggctgggggcgatctctttttcctgccgttcctgtacggcagcaacgccggactcgagatgaccagtggtttctacgggatgcaggccattcacacccgcgcgcacctgttgcaggccatctatgaaggggtggtgttcagccatatgacccacctcaaccgaatgcgcgaacgttttactgatgttcacaccctacgcgtcactggcggcccggcgcactccgatgtctggatgcaaatgctggcggacgtcagcggtctgcgtatcgagctgccgcaggtggaagaaaccggctgctttggtgcggcccttgccgcccgcgtcggcaccggggtttatcacaacttcagcgaagcccaacgtgacttgcgacacccggtgcgcaccctgctgccagatatgaccgcccatcagctttaccaaaaaaaatatcaacgttatcagcatctcattgccgcacttcagggctttcacgcccgcattaaggagcacacattatga

SEQ ID NO: 47289 - DNA, 1629 bp, Escherichia coli
gtgatagctgtcgtaaagctgttaccgactggcgaagatttcgccagtcacgtctacccttgttatacctcacaccgcaaggagacgatcatgaccaataatcccccttcagcacagattaagcccggcgagtatggtttccccctcaagttaaaagcccgctatgacaactttattggcggcgaatgggtagcccctgccgacggcgagtattaccagaatctgacgccggtgaccgggcagctgctgtgcgaagtggcgtcttcgggcaaacgagacatcgatctggcgctggatgctgcgcacaaagtgaaagataaatgggcgcacacctcggtgcaggatcgtgcggcgattctgtttaagattgccgatcgaatggaacaaaacctcgagctgttagcgacagctgaaacctgggataacggcaaacccattcgcgaaaccagtgctgcggatgtaccgctggcgattgaccatttccgctatttcgcctcgtgtattcgggcgcaggaaggtgggatcagtgaagttgatagcgaaaccgtggcctatcatttccatgaaccgttaggcgtggtggggcagattatcccgtggaacttcccgctgctgatggcgagctggaaaatggctcccgcgctggcggcgggcaactgtgtggtgctgaaacccgcacgtcttaccccgctttctgtactgctgctaatggaaattgtcggtgatttactgccgccgggcgtggtgaacgtggtcaatggcgcaggtggggtaattggcgaatatctggcgacctcgaaacgcatcgccaaagtggcgtttaccggctcaacggaagtgggccaacaaattatgcaatacgcaacgcaaaacattattccggtgacgctggagttgggcggtaagtcgccaaatatcttctttgctgatgtgatggatgaagaagatgcctttttcgataaagcgctggaaggctttgcactgtttgcctttaaccagggcgaagtttgcacctgtccgagtcgtgctttagtgcaggaatctatctacgaacgctttatggaacgcgccatccgccgtgtcgaaagcattcgtagcggtaacccgctcgacagcgtgacgcaaatgggcgcgcaggtttctcacgggcaactggaaaccatcctcaactacattgatatcggtaaaaaagagggcgctgacgtgctcacaggcgggcggcgcaagctgctggaaggtgaactgaaagacggctactacctcgaaccgacgattctgtttggtcagaacaatatgcgggtgttccaggaggagatttttggcccggtgctggcggtgaccaccttcaaaacgatggaagaagcgctggagctggcgaacgatacgcaatatggcctgggcgcgggcgtctggagccgcaacggtaatctggcctataagatggggcgcggcatacaggctgggcgcgtgtggaccaactgttatcacgcttacccggcacatgcggcgtttggtggctacaaacaatcaggtatcggtcgcgaaacccacaagatgatgctggagcattaccagcaaaccaagtgcctgctggtgagctactcggataaaccgttggggctgttctga

SEQ ID NO: 47290 - DNA, 1149 bp, Escherichia coli
atggcagcttcaacgttctttattccttctgtgaatgtcatcggcgctgattcattgactgatgcaatgaatatgatggcagattatggatttacccgtaccttaattgtcactgacaatatgttaacgaaattaggtatggcgggcgatgtgcaaaaagcactggaagaacgcaatatttttagcgttatttatgatggcacccaacctaaccccaccacggaaaacgtcgccgcaggtttgaaattacttaaagagaataattgcgatagcgtgatctccttaggcggtggttctccacacgactgcgcaaaaggtattgcgctggtggcagccaatggcggcgatattcgcgattacgaaggcgttgaccgctctgcaaaaccgcagctgccgatgatcgccatcaataccacggcgggtacggcctctgaaatgacccgtttctgcatcatcactgacgaagcgcgtcatatcaaaatggcgattgttgataaacatgtcactccgctgctttctgtcaatgactcctctctgatgattggtatgccgaagtcactgaccgccgcaacgggtatggatgccttaacgcacgctatcgaagcatatgtttctattgccgccacgccgatcactgacgcttgtgcactgaaagccgtgaccatgattgccgaaaacctgccgttagccgttgaagatggcagtaatgcgaaagcgcgtgaagcaatggcttatgcccagttcctcgccggtatggcgttcaataatgcttctctgggttatgttcatgcgatggcgcaccagctgggcggtttctacaacctgccacacggtgtatgtaacgccgttttgctgccgcacgttcaggtattcaacagcaaagtcgccgctgcacgtctgcgtgactgtgccgctgcaatgggcgtgaacgtgacaggtaaaaacgacgcggaaggtgctgaagcctgcattaacgccatccgtgaactggcgaagaaagtggatatcccggcaggcctacgcgacctgaacgtgaaagaagaagatttcgcggtattggcgactaatgccctgaaagatgcctgtggctttactaacccgatccaggcaactcacgaagaaattgtggcgatttatgcagcgaggtaa

SEQ ID NO: 47291 - DNA, 1020 bp, Escherichia coli
atgaaccaacgtaatgcttcaatgactgtgatcggtgccggctcgtacggcaccgctcttgccatcaccctggcaagaaatggccacgaggttgtcctctggggccatgaccctgaacatatcgcaacgcttgaacgcgaccgctgtaacgccgcgtttctccccgatgtgccttttcccgatacgctccatcttgaaagcgatctcgccactgcgctggcagccagccgtaatattctcgtcgtcgtacccagccatgtctttggtgaagtgctgcgccagattaaaccactgatgcgtcctgatgcgcgtctggtgtgggcgaccaaagggctggaagcggaaaccggacgtctgttacaggacgtggcgcgtgaggccttaggcgatcaaattccgctggcggttatctctggcccaacgtttgcgaaagaactggcggcaggtttaccgacagctatttcgctggcctcgaccgatcagacctttgccgatgatctccagcagctgctgcactgcggcaaaagtttccgcgtttacagcaatccggatttcattggcgtgcagcttggcggcgcggtgaaaaacgttattgccattggtgcggggatgtccgacggtatcggttttggtgcgaatgcgcgtacggcgctgatcacccgtgggctggctgaaatgtcgcgtcttggtgcggcgctgggtgccgaccctgccacctttatgggcatggcggggcttggcgatctggtgcttacctgtaccgacaaccagtcgcgtaaccgccgttttggcatgatgctcggtcagggcatggatgtacaaagcgcgcaggagaagattggtcaggtggtggaaggctaccgcaatacgaaagaagtccgcgaactggcgcatcgcttcggcgttgaaatgccaataaccgaggaaatttatcaagtattatattgcggaaaaaacgcgcgcgaggcagcattgactttactaggtcgtgcacgcaaggacgagcgcagcagccactaa

SEQ ID NO: 47292 - DNA, 1545 bp, Escherichia coli
atgttggtttctaaaaaacctatggtactggtgattctggatggctatggctatcgcgaagaacagcaggataacgccatttttagtgctaaaaccccggtaatggatgcactgtgggccaatcgtccgcataccctaatcgacgcttccggtctggaagtcggtctgcctgaccgtcagatgggtaactccgaagtaggccacgttaacctgggtgccggccgcatcgtgtatcaggacctgactcgtctggacgttgaaatcaaagatcgcgctttctttgctaatccggtgctgactggcgcggtagataaagcgaaaaacgcaggcaaagcggtacacattatgggtctgctctccgcaggcggcgtacacagccacgaagatcacatcatggcgatggtagaactggcagctgaacgcggcgcagaaaaaatctacctgcacgcattccttgacggtcgcgacactccgccgcgcagtgctgaatcctcgctgaaaaaattcgaagaaaaatttgccgcgctgggcaaaggccgcgtagcgtccatcattggtcgttactacgcgatggaccgcgataaccgttgggatcgcgtagaaaaagcttatgacctgctgactctggcgcagggcgagttccaggccgataccgccgttgctggtttgcaggctgcttatgctcgcgacgaaaatgatgaattcgtgaaagcgaccgttatccgtgctgaaggtcagccagacgcggcaatggaagacggcgatgcactgattttcatgaacttccgtgctgaccgcgcgcgtgaaatcactcgtgctttcgtgaacgctgatttcgatggcttcgcgcgtaagaaagtggttaacgtcgatttcgtgatgctgaccgaatacgccgctgacatcaaaactgcggttgcttacccacccgcttccctggttaacaccttcggcgagtggatggcgaaaaacgacaaaactcagttgcgtatttccgaaaccgaaaaatatgcccacgttactttcttcttcaacggtggcgtagaagagtcgttcaaaggcgaagatcgcattctgatcaactcaccgaaagtggctacctacgatctgcaaccggaaatgagctccgcagagctgaccgaaaaactggttgcggccatcaagagcggcaaatacgacaccatcatctgtaactatccgaacggcgacatggtaggtcacaccggggtgatggaagcggcggttaaagcggttgaagcgctggatcactgcgtggaagaagtcgcgaaagcggttgagtccgtgggtggacaactgctgatcaccgctgaccacggtaacgctgagcagatgcgcgatccggcaacgggtcaggcacacacggcacacaccaacctgccagttccgctgatttacgttggtgataagaacgtgaaagcggttgaaggcggcaaactttctgacatcgcgccgaccatgttgtcgctgatgggtatggaaatcccgcaagagatgactggtaagccgctgttcatcgtggaataa

SEQ ID NO: 47293 - DNA, 1026 bp, Escherichia coli
atgaaagcgttatccaaactgaaagcggaagagggcatctggatgaccgacgttcctgtaccggaactcgggcataacgatctgctgattaaaatccgtaaaacagccatctgcgggactgacgttcacatctataactgggatgagtggtcgcaaaaaaccatcccggtgccgatggtcgtgggccatgaatatgtcggtgaagtggtaggtattggtcaggaagtgaaaggcttcaagatcggcgatcgcgtttctggcgaaggccatatcacctgtggtcattgccgcaactgtcgtggtggtcgtacccatttgtgccgcaacacgataggcgttggtgttaatcgcccgggctgctttgccgaatatctggtgatcccggcattcaacgccttcaaaatccccgacaatatttccgatgacttagccgcaatttttgatcccttcggtaacgccgtgcataccgcgctgtcgtttgatctggtgggcgaagatgtgctggtttctggtgcaggcccgattggtattatggcagcggcggtggcgaaacacgttggtgcacgcaatgtggtgatcactgatgttaacgaataccgccttgagctggcgcgtaaaatgggtatcacccgtgcggttaacgtcgccaaagaaaatctcaatgacgtgatggcggagttaggcatgaccgaaggttttgatgtcggtctggaaatgtccggtgcgccgccagcgtttcgtaccatgcttgacaccatgaatcacggcggccgtattgcgatgctgggtattccgccgtctgatatgtctatcgactggaccaaagtgatctttaaaggcttgttcattaaaggtatttacggtcgtgagatgtttgaaacctggtacaagatggcggcgctgattcagtctggcctcgatctttcgccgatcattacccatcgtttctctatcgatgatttccagaagggctttgacgctatgcgttcgggccagtccgggaaagttattctgagctgggattaa

SEQ ID NO: 47294 - DNA, 1197 bp, Escherichia coli
atgcgtggagaattttatcagcagttaaccaacgatctggaaaccgcacgggcggaagggttgtttaaagaagagcgcattattacgtctgcgcagcaagcagatatcactgtggctgatggaagccacgtcattaacttttgtgccaacaactatctcgggctggcgaatcatcctgatctgattgcggcggcaaaggcgggaatggattctcacggtttcggcatggcttcggtgcgttttatttgcggcactcaggacagccataaagagcttgaacaaaaactggcggccttcctggggatggaagatgcgattctctactcttcctgctttgatgctaacggtggcctgtttgaaacgcttctgggtgcggaagacgccattatctccgacgcactgaaccacgcgtctattattgatggtgtgcgtctgtgcaaagctaaacgctatcgctatgccaacaacgatatgcaggagctggaagcacgtctgaaagaagcgcgtgaagccggtgcgcgtcatgtgctgatcgccaccgatggtgtgttctcaatggacggcgtgattgccaacctgaagggcgtttgcgatctggcagataaatatgatgccctggtgatggtagacgactcccacgcggtcggttttgtcggtgaaaatggtcgtggttcccatgaatactgcgatgtgatgggccgggtcgatattatcaccggtacgcttggtaaagcgctgggcggggcttctggtggttataccgcggcgcgcaaagaagtggttgagtggctgcgccagcgttctcgtccgtacctgttctccaactcgctggcaccggccattgttgccgcgtccatcaaagtactggagatggtcgaagcgggcagcgaactgcgtgaccgtctgtgggcgaacgcgcgtcagttccgtgagcaaatgtcggcggcgggctttaccctggcgggagccgatcacgccattattccggtcatgcttggtgatgcggtagtggcgcagaaatttgcccgtgagctgcaaaaagagggcatttacgttaccggtttcttctatccggtcgttccgaaaggtcaggcgcgtattcgtacccagatgtctgcggcgcatacccctgagcaaattacgcgtgcagtagaagcatttacgcgtattggtaaacaactgggcgttatcgcctga

SEQ ID NO: 47295 - DNA, 2319 bp, Escherichia coli
atgaaaattagcgatggaaactggttgattcaacctggcctcaatttgattcacccgcttcaggtgttcgaggttgaacagcaggataatgaaatggtggtctatgctgccccccgtgatgtgcgtgaacgtacctggcagcttgatacgcctttatttacgttgcgctttttctccccacaggaaggtattgtcggtgtgcggattgagcattttcagggggcgctgaataacggtcctcattatccgctcaatattttgcaggacgtgaaggtcacaatcgaaaacacagaacgttatgctgagtttaaaagtggcaacttaagcgcgcgtgtcagcaaaggtgagttctggtcactggattttctgcgcaacggcgaacgtattaccggtagtcaggtgaaaaataatggctacgtgcaggacacgaataatcaacgcaattatatgtttgagcggcttgatcttggcgttggcgaaacagtttacggtctgggagagcgctttactgccctggtgcgcaatggccagacggtagagacctggaaccgggacggcggcacaagtactgaacaggcgtataaaaatatcccgttctacatgactaaccgtggttatggggtactggtcaatcatccccagtgtgtctcttttgaagtgggatcggagaaagtctccaaagtgcagttcagcgttgagagtgaatatctcgaatactttgttatcgacggcccgacgccgaaagcggtacttgatcgttatacccgctttactggtcgtccggcgctgccgcccgcgtggtccttcggcctgtggctaaccacttcatttaccaccaactacgacgaagcgacggtaaacagctttatcgatggtatggcggaacgcaatctgccgctgcatgttttccactttgactgtttctggatgaaagccttccagtggtgcgattttgagtgggacccgctgactttccctgacccggaagggatgatccgccgcctgaaagcgaaaggactgaaaatctgcgtctggattaacccctatatcggtcaaaaatcccccgtctttaaagagttacaagagaaaggctatttactcaaacgcccggacggttcgctatggcagtgggataaatggcagccaggtctggcgatttatgactttaccaatccggatgcctgcaaatggtacgccgacaaactgaaaggtctggtcgcgatgggcgttgattgctttaagaccgactttggcgaacgtatcccaactgatgttcagtggtttgacggttccgatccgcagaaaatgcataaccattatgcgtacatctacaacgaactggtgtggaacgtgctcaaggacaccgttggtgaggaagaagctgtcttgtttgcccgctcggcctccgtcggtgcgcagaaattcccggtacactggggtggcgattgttacgctaactacgaatcaatggcggaaagcctgcgcggtggtttgtctattggcctttcaggttttggcttctggagccacgatatcggcggctttgaaaataccgctccggcgcacgtttacaaacgctggtgcgcgtttggtttgctctccagccatagccgtttacacggtagcaaatcttatcgtgtgccgtgggcctacgatgatgagtcctgtgatgtggtgcgcttcttcacgcaactgaaatgccgcatgatgccgtatctgtatcgtgaagctgcgcgtgcgaacgcgcggggtacgccgatgatgcgggccatgatgatggagttcccggacgatccggcttgtgattaccttgaccgtcaatacatgttaggcgacaacgtgatggttgcgccggtgttcactgaagcgggcgatgtgcagttctacctgccggaaggtcgctggacacacctgtggcacaacgatgaactcgacggtagtcgctggcataaacagcagcacggcttcctgagtctgcccgtttatgtgcgtgataacactctactggcgctgggcaacaacgatcaacgtcccgattacgtgtggcacgaaggcacggcattccacctcttcaatctgcaagacgggcatgaagccgtctgtgaagtgcccgctgctgacggatcggtgatctttactttaaaagcagcacgtactggcaacacgattactgtgactggtgcgggcgaggcgaagaactggacactgtgcctgcgcaatgttgtgaaagtaaatggtctgcaagacggttcgcaggctgaaagtgagcaggggctggtggtgaagcctcaagggaatgcgctgacaattacgttgtaa

SEQ ID NO: 47296 - DNA, 1086 bp, Escherichia coli
gtgatgaatgtgagtgaaaagatggaacatttcgacgtggcgattattggcctcggcccggcaggatcggcgttggcacgaaagttagcaggcaaaatgcaggtgatcgcgctggataaaaagcaccagtgtggtactgaaggtttcagcaaaccctgcggcggtctgctggcaccggacgcgcagcgatcttttattcgcgatgggctgacgcttcctgtcgatgtgatcgctaatccgcagattttcagcgtcaaaaccgtcgacgtcgccgcatcgctcacgcgtaactaccagcgaagctatatcaatattaatcgccatgctttcgacttgtggatgaaatcgctgatccccgccagcgttgaggtttatcacgacagcctgtgccgaaaaatctggcgtgaggatgataaatggcatgtcatttttcgtgcagacggctgggagcaacatattaccgcccgctatctggtcggtgccgatggcgcaaactcgatggtgcggcgacatctctacccggatcatcaaatccgtaaatatgtcgctatccagcagtggttcgcggagaaacatccggtgccgttctactcctgcatctttgataattcgataactaactgttattcatggagtatcagcaaagacggttattttatctttggcggtgcctatccaatgaaagacggtcagacgcgtttcacgacgctgaaagagaaaatgagcgcctttcagttccagtttggtaagacggtgaaaagcgaaaaatgcacggtgctgtttccctcgcgctggcaggattttgtctgcggtaaggacaacgcctttctgattggtgaagcggcgggatttatcagcgccagctcgctggaggggattagctatgcgctggatagcacagacattctgcgttcggtgttactgaagcagccagagaagctcaataccgcttactggcgcgccacccgcaaactgcgtttaaaactcttcggcaagatagtaaaaagccgatgcctgaccgcaccggctttaagaaagtggattatgcgcagtggtgtggcacatattccacagttgaaggattag

SEQ ID NO: 47297 - DNA, 666 bp, Escherichia coli
atgtcccggatagaagcggtatttttcgactgcgacggtacgctggtcgacagtgaagtcatttgctctcgcgcatatgtaacgatgtttcaggaatttggtattacgctcgatcctgaagaggtattcaaacgtttcaaaggtgtaaaactgtacgaaattatcgatattgtttcccttgaacatggtgttacgttagcgaaaacagaagctgaacacgtttaccgtgcagaagtcgctcggctgttcgattcagaactggaagccatcgaaggggctggagcgctcctgtcagcgatcactgcgccaatgtgtgtggtatctaacggcccaaataacaaaatgcagcattctatgggcaagctgaatatgttgcactacttcccggataaactgttcagcggctacgatattcagcgctggaagccagacccggcgttaatgttccatgcggcaaaagcgatgaatgtaaatgtagaaaactgcattctggttgatgactcagttgccggtgcacaatctggtatcgacgcaggtatggaagtgttctacttctgcgccgacccgcacaataagccgatcgttcacccgaaagtcaccacctttacccatctttcgcagttacctgaactgtggaaagcgcgtggttgggatattacggcatag

SEQ ID NO: 47298 - DNA, 1830 bp, Escherichia coli
atgtgtggaattgttggcgcgatcgcgcaacgtgatgtagcagaaatccttcttgaaggtttacgtcgtctggaataccgcggatatgactctgccggtctggccgttgttgatgcagaaggtcatatgacccgcctgcgtcgcctcggtaaagtccagatgctggcacaggcagcggaagaacatcctctgcatggcggcactggtattgctcacactcgctgggcgacccacggtgaaccttcagaagtgaatgcgcatccgcatgtttctgaacacattgtggtggtgcataacggcatcatcgaaaaccatgaaccgctgcgtgaagagctaaaagcgcgtggctataccttcgtttctgaaaccgacaccgaagtgattgcccatctggtgaactgggagctgaaacaaggcgggactctgcgtgaggccgttctgcgtgctatcccgcagctgcgtggtgcgtacggtacagtgatcatggactcccgtcacccggataccctgctggcggcacgttctggtagtccgctggtgattggcctggggatgggcgaaaactttatcgcttctgaccagctggcgctgttgccggtgacccgtcgctttatcttccttgaagagggcgatattgcggaaatcactcgccgttcggtaaacatcttcgataaaactggcgcggaagtaaaacgtcaggatatcgaatccaatctgcaatatgacgcgggcgataaaggcatttaccgtcactacatgcagaaagagatctacgaacagccgaacgcgatcaaaaacacccttaccggacgcatcagccacggtcaggttgatttaagcgagctgggaccgaacgccgacgaactgctgtcgaaggttgagcatattcagatcctcgcctgtggtacttcttataactccggtatggtttcccgctactggtttgaatcgctagcaggtattccgtgcgacgtcgaaatcgcctctgaattccgctatcgcaaatctgccgtgcgtcgtaacagcctgatgatcaccttgtcacagtctggcgaaaccgcggataccctggctggcctgcgtctgtcgaaagagctgggttaccttggttcactggcaatctgtaacgttccgggttcttctctggtgcgcgaatccgatctggcgctaatgaccaacgcgggtacagaaatcggcgtggcatccactaaagcattcaccactcagttaactgtgctgttgatgctggtggcgaagctgtctcgcctgaaaggtctggatgcctccattgaacatgacatcgtgcatggtctgcaggcgctgccgagccgtattgagcagatgctgtctcaggacaaacgcattgaagcgctggcagaagatttctctgacaaacatcacgcgctgttcctgggccgtggcgatcagtacccaatcgcgctggaaggcgcattgaagttgaaagagatctcttacattcacgctgaagcctacgctgctggcgaactgaaacacggtccgctggcgctaattgatgccgatatgccggttattgttgttgcaccgaacaacgaattgctggaaaaactgaaatccaacattgaagaagttcgcgcgcgtggcggtcagttgtatgtcttcgccgatcaggatgcgggttttgtaagtagcgataacatgcacatcatcgagatgccgcatgtggaagaggtgattgcaccgatcttctacaccgttccgctgcagctgctggcttaccatgtcgcgctgatcaaaggcaccgacgttgaccagccgcgtaacctggcaaaatcggttacggttgagtaa

SEQ ID NO: 47299 - DNA, 1383 bp, Escherichia coli
atggctactggaaagattgtccaggtaatcggcgccgtagttgacgtcgaattccctcaggatgccgtaccgcgcgtgtacgatgctcttgaggtgcaaaatggtaatgagcgtctggtgctggaagttcagcagcagctcggcggcggtatcgtacgtaccatcgcaatgggttcctccgacggtctgcgtcgcggtctggatgtaaaagacctcgaacacccgattgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagctcattcgtaacatcgcgatcgagcactccggttactctgtgtttgcgggcgtaggtgaacgtactcgtgagggtaacgacttctaccacgaaatgaccgactccaacgttatcgacaaagtatccctggtgtatggccagatgaacgagccgccgggaaaccgtctgcgcgttgctctgaccggtctgaccatggctgagaaattccgtgacgaaggtcgtgacgttctgctgttcgttgacaacatctatcgttacaccctggccggtacggaagtatccgcactgctgggccgtatgccttcagcggtaggttatcagccgaccctggcggaagagatgggcgttctgcaggaacgtatcacctccaccaaaactggttctatcacctccgtacaggcagtatacgtacctgcggatgacttgactgacccgtctccggcaaccacctttgcgcaccttgacgcaaccgtggtactgagccgtcagatcgcgtctctgggtatctacccggccgttgacccgctggactccaccagccgtcagctggacccgctggtggttggtcaggaacactacgacaccgcgcgtggcgttcagtccatcctgcaacgttatcaggaactgaaagacatcatcgccatcctgggtatggatgaactgtctgaagaagacaaactggtggtagcgcgtgctcgtaagatccagcgcttcctgtcccagccgttcttcgtggcagaagtattcaccggttctccgggtaaatacgtctccctgaaagacaccatccgtggctttaaaggcatcatggaaggcgaatacgatcacctgccggagcaggcgttctacatggtcggttccatcgaagaagctgtggaaaaagccaaaaaactttaa

SEQ ID NO: 47300 - DNA, 864 bp, Escherichia coli
atggccggcgcaaaagagatacgtagtaagatcgcaagcgtccagaacacgcaaaagatcactaaagcgatggagatggtcgccgcttccaaaatgcgtaaatcgcaggatcgcatggcggccagccgtccttatgcagaaaccatgcgcaaagtgattggtcaccttgcacacggtaatctggaatataagcacccttacctggaagaccgcgacgttaaacgcgtgggctacctggtggtgtcgaccgaccgtggtttgtgcggtggtttgaacattaacctgttcaaaaaactgctggcggaaatgaagacctggaccgacaaaggcgttcaatgcgacctcgcaatgatcggctcgaaaggcgtgtcgttcttcaactccgtgggcggcaatgttgttgcccaggtcaccggcatgggggataacccttccctgtccgaactgatcggtccggtaaaagtgatgttgcaggcctacgacgaaggccgtctggacaagctttacattgtcagcaacaaatttattaacaccatgtctcaggttccgaccatcagccagctgctgccgttaccggcatcagatgatgatgatctgaaacataaatcctgggattacctgtacgaacccgatccgaaggcgttgctggataccctgctgcgtcgttatgtcgaatctcaggtttatcagggcgtggttgaaaacctggccagcgagcaggccgcccgtatggtggcgatgaaagccgcgaccgacaatggcggcagcctgattaaagagctgcagttggtatacaacaaagctcgtcaggccagcattactcaggaactcaccgagatcgtctcgggggccgccgcggtttaa

SEQ ID NO: 47301 - DNA, 1542 bp, Escherichia coli
atgcaactgaattccaccgaaatcagcgaactgatcaagcagcgcattgctcagttcaatgttgtgagtgaagctcacaacgaaggtactattgtttctgtaagtgacggtgttatccgcattcacggcctggccgattgtatgcagggtgaaatgatctccctgccgggtaaccgttacgctatcgcactgaacctcgagcgcgactctgtaggtgcggttgttatgggtccgtacgctgaccttgccgaaggcatgaaagttaagtgtactggccgtatcctggaagttccggttggccgtggcctgctgggccgtgtggttaacactctgggtgcaccaatcgacggtaaaggtccgctggatcacgacggcttctctgctgtagaagcaatcgctccgggcgttatcgaacgtcagtccgtagatcagccggtacagaccggttataaagccgttgactccatgatcccaatcggtcgtggtcagcgtgaattgatcatcggtgaccgtcagacaggtaaaaccgcactggctatcgatgccatcatcaaccagcgcgattccggtatcaaatgtatctatgtcgctatcggccagaaagcgtccaccatttctaacgtggtacgtaaactggaagagcacggcgcactggctaacaccatcgttgtggtagcaaccgcgtctgaatccgctgcactgcaatacctggcaccgtatgccggttgcgcaatgggcgaatacttccgtgaccgcggtgaagatgcgctgatcatttacgatgacctgtctaaacaggctgttgcttaccgtcagatctccctgctgctccgtcgtccgccaggacgtgaagcattcccgggcgacgttttctacctccactctcgtctgctggagcgtgctgcacgtgttaacgccgaatacgttgaagccttcaccaaaggtgaagtgaaagggaaaaccggttctctgaccgcactgccgattatcgaaactcaggcgggtgacgtttctgcgttcgttccgaccaacgtaatctccattaccgatggtcagatcttcctggaaaccaacctgttcaacgccggtattcgtcctgcggttaacccgggtatttccgtatcccgtgttggtggtgcagcacagaccaagatcatgaaaaaactgtccggtggtatccgtaccgctctggcacagtatcgtgaactggcagcgttctctcagtttgcatccgaccttgacgatgcaacacgtaagcagcttgaccacggtcagaaagtgaccgaactgctgaaacagaaacagtatgcgccgatgtccgttgcgcagcagtctctggttctgttcgcagcagaacgtggttacctggcggatgttgaactgtcgaaaattggcagcttcgaagccgctctgctggcttacgtcgaccgtgatcacgctccgttgatgcaagagatcaaccagaccggtggctacaacgacgaaatcgaaggcaagctgaaaggcatcctcgattccttcaaagcaacccaatcctggtaa

SEQ ID NO: 47302 - DNA, 534 bp, Escherichia coli
atgtctgaatttattacggtagctcgcccctacgccaaagcagcttttgactttgccgtcgaacaccaaagtgtagaacgctggcaggacatgctggcgtttgccgccgaggtaaccaaaaacgaacaaatggcagagcttctctctggcgcgcttgcgccagaaacgctcgccgagtcgtttatcgcagtttgtggtgagcaactggacgaaaacggtcagaacctgattcgggttatggctgaaaatggtcgtcttaacgcgctcccggatgttctggagcagtttattcacctgcgtgccgtgagtgaggctaccgctgaggtagacgtcatttccgctgccgcactgagtgaacaacagctcgcgaaaatttctgctgcgatggaaaaacgtctgtcacgcaaagttaagctgaattgcaaaatcgataagtctgtaatggcaggcgttatcatccgagcgggtgatatggtcattgatggcagcgtacgcggtcgtcttgagcgccttgcagacgtcttgcagtcttaa

SEQ ID NO: 47303 - DNA, 930 bp, Escherichia coli
atgcaaaacgcaggcagcctcgttgttcttggcagcattaatgctgaccacattcttaatcttcaatcttttcctactccaggcgaaaccgtaaccggtaaccactatcaggttgcatttggcggcaaaggcgcgaatcaggctgtggctgctgggcgtagcggtgcgaatatcgcgtttattgcctgtacgggtgatgacagcattggtgagagcgttcgccagcagctcgccactgataacattgatattactccggtcagcgtgatcaaaggcgaatcaacaggtgtggcgctgatttttgttaatggcgaaggtgagaatgtcatcggtattcatgccggcgctaatgctgccctttccccggcgctggtggaagcgcaacgtgagcgtattgccaacgcgtcagcattattaatgcagctggaatcaccactcgaaagtgtgatggcagcggcgaaaatcgcccatcaaaataagactatcgttgcgcttaacccggctccggctcgcgaacttcctgacgaactgctggcgctggtggacattattacgccaaacgaaacggaagcagaaaagctcaccggtattcgtgttgaaaatgatgaagatgcagcgaaggcggcgcaggtactgcatgaaaaaggtatccgtactgtactgattactttaggaagtcgtggtgtatgggctagcgtgaatggtgaaggtcagcgcgttcctggattccgggtgcaggctgtcgataccattgctgccggagatacctttaacggtgcgttaatcacggcattgctggaagaaaaaccattgccagaggcgattcgttttgcccatgctgccgctgcgattgccgtaacacgtaaaggcgcacaaccttccgtaccgtggcgtgaagagatcgacgcatttttagacaggcagaggtga

SEQ ID NO: 47304 - DNA, 2022 bp, Escherichia coli
atgcgtctaaaccccggccaacaacaagctgtcgaattcgttaccggcccctgcctggtgctggcgggcgcgggttccggtaaaactcgtgttatcaccaataaaatcgcccatctgatccgcggttgcggttatcaggcgcggcacattgcggcggtgacctttactaataaagcagcgcgcgagatgaaagagcgtgtagggcagacgctggggcgcaaagaggcgcgtgggctgatgatctccactttccatacgttggggctggatatcatcaaacgcgagtatgcggcgcttgggatgaaagcgaacttctcgttgtttgacgataccgatcagcttgctttgcttaaagagttgaccgaggggctgattgaagatgacaaagttctcctgcaacaactgatttcgaccatctctaactggaagaatgatctcaaaacaccgtcccaggcggcagcaagtgcgattggcgagcgggaccgtatttttgcccattgttatgggctgtatgatgcacacctgaaagcctgtaacgttctcgacttcgatgatctgattttattgccgacgttgctgctgcaagccaatgaagaagtccgcaagcgctggcagaacaaaattcgctatctgctggtggatgagtatcaggacaccaacaccagccagtatgagctggtgaaactgctggtgggcagccgcgcgcgctttaccgtggtgggtgacgatgaccagtcgatctactcctggcgcggtgcacgtccgcaaaacctggtgctgctgagtcaggattttccggcgctgaaggtgattaagcttgagcagaactatcgctcttccgggcgtattctgaaagcggcgaacatcctgatcgccaataacccgcacgtctttgaaaagcgtctgttctccgaactgggttatggcgcggagctaaaagtattaagcgcgaataacgaagaacatgaggctgagcgcgttactggcgagctgatcgcccatcacttcgtcaataaaacgcagtacaaagattacgccattctttatcgcggtaaccatcagtcgcgggtgtttgaaaaattcctgatgcaaaaccgcatcccgtacaaaatatctggtggtacgtcgtttttctctcgtcctgaaatcaaggacttgctggcttatctgcgcgtgctgactaacccggacgatgacagcgcatttctgcgtatcgttaacacgccgaagcgagagattggcccggctacgctgaaaaagctgggtgagtgggcgatgacgcgcaataaaagcatgtttaccgccagctttgatatgggcctgagtcagacgcttagcggacgtggttatgaagcattgacccgcttcactcactggttggcagaaatccagcgtctggcggagcgggagccgattgccgcggtgcgtgatctgatccatggcatggattatgaatcctggctgtacgaaacatcgcccagcccgaaagccgccgaaatgcgcatgaagaacgtcaaccaactgtttagctggatgacggagatgctggaaggcagtgaactggatgagccgatgacgctcacccaggtggtgacgcgctttactttgcgcgacatgatggagcgtggtgagagtgaagaagagctggatcaggtgcaactgatgactctccacgcgtcgaaagggctggagtttccttatgtctacatggtcggtatggaagaagggtttttgccgcaccagagcagcatcgatgaagataatatcgatgaggagcggcggctggcctatgtcggcattacccgcgcccagaaggaattgacctttacgctgtgtaaagaacgccgtcagtacggcgaactggtgcgcccggagccgagccgctttttgctggagctgccgcaggatgatctgatttgggaacaggagcgcaaagtggtcagcgccgaagaacggatgcagaaagggcaaagccatctggcgaatctgaaagcgatgatggcggcaaaacgagggaaataa

SEQ ID NO: 47305 - DNA, 1266 bp, Escherichia coli
atgagcaaaacacatttaacagaacagaagttttccgacttcgccctgcatccgaaggttgtagaagcccttgaaaaaaaagggtttcataactgtacgcccattcaggcactggcccttccgctgacgctggcgggtcgtgacgtagccgggcaggcgcaaaccggtaccgggaaaacgatggcgtttcttacgtcaacgtttcattatcttctctctcatcctgcgattgccgatcgcaaggtgaatcagccgcgtgccttaattatggcaccgacgcgtgaacttgccgtgcagatccatgccgacgcagaaccgctggcggaagctactggcctgaagctgggtctggcttacggtggtgatggctacgacaaacagctgaaagtgctggaaagcggcgttgacattctgattggcaccacggggcgtttaattgactacgccaagcagaaccacattaacctcggtgccattcaggtggtggtactggacgaagccgatcgcatgtacgatctgggctttattaaagatatccgctggctgttccgccgtatgccgcctgcaaaccagcgcctcaacatgctgttctccgccacgctttcgtaccgggtacgtgaactggcgttcgagcagatgaacaatgccgaatatattgaagtggaaccggaacagaaaacgggccaccgtattaaagaagagcttttctacccttctaacgaagaaaaaatgcgtttgctgcaaacgctgatcgaagaagagtggccagacagagcgattattttcgccaacaccaaacaccgttgtgaagagatctggggccacctggcagcagatggtcatcgtgtcggtttattgacaggcgatgtcgcgcagaaaaaacgtctgcgtattcttgatgaatttacccgtggcgatctggatattctggttgccaccgacgttgccgcgcgtggtttgcatattccggcagtgacgcacgtctttaactacgatttacccgatgactgtgaagattacgttcaccgtattggtcgtacaggtcgcgcaggcgcaagcggtcactctatcagcctggcgtgtgaagagtatgcattgaatttgcctgctattgagacctatattggtcactcaattccggtaagcaaatacaatccggacgcattgatgaccgatctgccaaaaccgctgcgcctcacgcgcccgcgcacaggcaatggtccgcgtcgtactggcgctccgcgtaatcgtcgtcgttcaggttaa

SEQ ID NO: 47306 - DNA, 1263 bp, Escherichia coli
atgagttttgcgaccatttctgttatcggactgggttatatcgggctgccaacggcagcagcgtttgcctcacggcaaaaacaggtaattggtgtcgatatcaaccaacatgcggttgataccatcaatcgtggcgaaatccatatcgtcgaacctgatttggcgagtgtagtaaaaactgccgtagaaggcggttttttacgagcgagcacgacgccagttgaagcggatcgctggctgattgctgtacccacgccgtttaagggcgatcatgagccagatatgacctacgttgaatcggctgctcgctccattgcgccagtgctgaaaaaaggcgcgctggtgatccttgaatccacctcgccggtggggtcaaccgagaagatggcagaatggttagcagagatgcgtccggatctcactttcccgcagcaggtgggcgagcaggcggacgtcaacattgcttactgcccggaacgcgtgttaccaggacaggtaatggtcgagctgattaaaaacgatcgcgtgattggtggtatgacgccggtttgttcggcccgcgccagcgaactgtacaaaattttcctcgaaggtgagtgtgtcgtcactaactcgcggacggcggaaatgtgtaagctcaccgaaaacagcttccgcgatgtgaatatcgcttttgctaatgaattgtcgctgatttgtgccgatcaggggattaacgtctgggaactgattcgcctggcgaatcgtcaccctcgcgttaatattcttcagcctggccctggcgtgggcggtcactgcattgctgttgatccgtggtttatcgtggcacagaacccccagcaggcgcggcttatccgtaccgcgcgcgaagtgaacgatcacaaaccgttctgggttatcgatcaggtgaaagcggcggtggctgattgcctggcggctaccgataaacgcgccagtgaactgaaaatcgcctgctttggtctggcgtttaaaccgaatattgatgacctgcgcgaaagcccggcgatggaaatcgctgaactgatcgcccagtggcatagcggcgaaactctggttgttgagcctaacatccaccagttgccgaaaaaactgaccgggctttgtactctggcgcagcttgacgaggcgctggcaacggcagacgtgctggtgatgctggtcgatcatagtcagttcaaagttatcaatggcgacaatgtccatcagcagtatgtcgtcgatgccaaaggagtctggcgctga

SEQ ID NO: 47307 - DNA, 882 bp, Escherichia coli
atgaaaggtattatcctggcgggcggttccggcacccgattgcatccgattacgcgcggcgtatcgaagcaactgttgccgatttacgataagccaatgatttactatccgctgtcggtgctgatgctggccggtatccgcgaaattctcatcatcactacgccggaagataaaggttatttccagcgcctgctgggcgatggtagtgagttcggtatccagctggaatatgccgaacagcccagcccggacggtctggcgcaggcctttatcatcggtgaaaccttccttaatggtgaaccttcttgtctggtgctgggcgataacatcttcttcggtcagggcttcagtccgaagctgcgtcatgttgcggcgcgcaccgaaggggcgacggtttttggctatcaggtgatggacccggaacgctttggcgtggtggagtttgacgacaatttccgcgctatctcgctggaagaaaagccaaaacagccgaagtcaaactgggcggtgaccgggctttatttctacgacagtaaagtcgtggagtacgcaaagcaggtgaagccgtcggagcgtggtgaactggagattacctccatcaaccagatgtacctcgaggcgggcaacctgaccgttgaactgctcgggcgcggatttgcctggctggataccggcactcacgacagcctgattgaagccagcacctttgtacagacggtggaaaaacgccagggctttaagattgcctgcctggaagagattgcctggcgtaacggctggctcgatgacgagggtgtgaagcgtgctgccagttcattagcgaaaactggctacggccaatatctgctggagttacttcgtgcccgtccgcgccagtattga

SEQ ID NO: 47308 - DNA, 1386 bp, Escherichia coli
atggcagataacaaaccagagctacagcgtgggctggaagctcgacatatcgaactcatcgccctggggggcaccattggcgtcggcctgtttatgggggccgccagtaccctgaaatgggccgggccatccgtattgttggcctatatcatcgccgggctgttcgtctttttcatcatgcgttcaatgggcgaaatgttgtccctcgaaccggttaccggttcgttcgccgtttatgcgcatcgttatatgagcccgttctttggctatctcaccgcctggtcttactggtttatgtggatggcggtggggatctctgaaatcaccgccattggcgtttatgtccagttctggttcccggagatggcgcagtggatacccgcattgatcgcagtggcgctggtggcgttggcgaatctggcggcggtgcggttgtacggcgaaatcgagttctggttcgcgatgatcaaagtcaccacgattatcgtgatgattgtcattggcctgggcgtgattttctttggctttggcaatggcgggcagtcgattggttttagcaatctcacagagcatggcggtttctttgcgggtggctggaaagggttcctgaccgctctgtgtattgtggtggcgtcctaccagggcgtggagctgattggcattactgccggtgaagcgaagaatccgcaggtgacgctgcgcagtgccgtaggcaaggtgctgtggcggatcctgattttctacgtaggcgcgattttcgttatcgtcaccatcttcccgtggaatgaaataggcagcaacggcagcccgttcgtactgacttttgccaaaatcggtattaccgcagcggcgggcattatcaactttgtggtgctgacggctgcgctctctggctgtaacagcggcatgtacagttgcggacgtatgctctacgcactggcgaaaaaccgtcagttaccggcggcaatggcgaaagtttcccgtcacggcgtaccggttgcgggtgtggcagtatctattgctattctgctaattgctcatgcctggaactacatcattcccaatccgcagcgtgtgtttgtctacgtctacagtgccagcgtgcttccggggatggtgccatggtttgtgatattgataagccagctgcgttttcggcgtgcacataaagcggcgattgccagccatccgttccgctcaatcctgttcccgtgggccaattacgtaacaatggcattcctgatttgcgttttgatcggcatgtactttaatgaagatacgcgtatgtcgctgtttgttggcatcatctttatgctggcggtgacggcgatttataaagtttttggccttaatcgccacgggaaagcgcataaactggaggaataa

SEQ ID NO: 47309 - DNA, 741 bp, Escherichia coli
atgagtatccttgtcacccgcccgtctcccgctggagaagagttagtgagccgtctgcgcacactggggcaggtggcctggcattttccgctgattgagttttctccgggtcaacaattaccgcaacttgctgatcaactggcagcgctgggggagagcgatctgttgtttgccctctcgcaacacgcggttgcttttgcccaatcacagctgcatcagcaagatcgtaaatggccccgactacctgattatttcgccattggacgcaccaccgcactggcactacataccgtaagtggacagaagattctctacccgcaggatcgggaaatcagcgaagtcttgctacaattacctgaattacaaaatattgcgggcaaacgtgcgctgatattacgtggcaatggtggtcgtgagctaattggggataccctgacggcgcgcggtgctgaggtcactttttgtgaatgttatcaacgatgcgcaatccattacgatggtgcagaagaagcgatgcgctggcaagcccgcgaggtgacgatggtcgttgttaccagcggtgaaatgttgcagcaactctggtcgctgatcccacaatggtatcgtgagcactggttactacactgtcgactattggtcgtcagtgagcgtttggcgaaactcgcccgggaactgggctggcaagacattaaggtcgccgataacgctgacaacgatgcgcttttacgggcattacaataa

SEQ ID NO: 47310 - DNA, 963 bp, Escherichia coli
atgataatgacggtaacaagcatgttagacaatgttttaagaattgccacacgccaaagcccacttgcactctggcaggcacactatgtcaaagacaagttgatggcgagccatccgggcctggtcgttgaactggtaccgatggtgacgcgcggcgatgtgattcttgatacgccgctggcgaaagtaggcggaaaaggcttatttgtaaaagagctggaagtcgcgctcctcgaaaatcgcgccgatatcgccgtacactcaatgaaagatgtgccggttgaattcccgcaaggtctgggactggtcactatttgtgagcgtgaagatcctcgcgatgcctttgtgtccaataactatgacagtctggatgcgttaccggcaggcagtatcgtcgggacgtccagtttacgtcgccagtgccaactggctgaacgccgtccggatctgattatccgctccctgcgcggcaacgtcggcactcgcctgagcaaactggataacggcgaatacgatgccatcattcttgccgtagccggactaaaacgtttaggtctggagtcacgtattcgcgccggcttgccacccgagatttctcttccggcggtaggacaaggtgcggtgggtattgaatgccgccttgatgattcacgcactcgcgagctgcttgccgcgctgaatcaccacgaaactgcactgcgcgttaccgcagaacgcgccatgaatacccgtctcgaaggcggatgtcaggtgccaattggtagctacgccgagcttattgatggcgaaatctggctgcgtgcgctggtcggccggccggacggttcgcagattattcgcggtgaacgccgcggtgcgccgcaagatgccgaacaaatggggatttcgctggcagaagagctactgaataacggcgcgcgcgagatcctcgctgaagtctataacggagacgccccggcatga

SEQ ID NO: 47311 - DNA, 828 bp, Escherichia coli
atgatgcagttctcgaaaatgcatggccttggcaacgattttatggtcgtcgacgcggtaacgcagaatgtctttttttcaccggagctgattcgtcgcctggctgatcggcacctgggggtagggtttgaccaactgctggtggttgagccgccgtatgatcctgaactggattttcactatcgcattttcaatgctgatggcagtgaagtggcgcagtgcggcaacggtgcgcgctgctttgcccgttttgtgcgtctgaaaggactgaccaataagcgtgatatccgcgtcagcaccgccaacgggcggatggttctgaccgtcaccgatgatgatctggtccgcgtaaatatgggcgaacccaacttcgaaccttccgccgtgccgtttcgcgctaacaaagcggaaaagacctatattatgcgcgccgccgagcagacaatcttatgcggcgtggtgtcgatgggaaatccgcattgcgtgattcaggtcgatgatgtcgataccgcggcggtagaaacgcttggtcctgttctggaaagccacgagcgttttccggagcgcgccaatatcggttttatgcaagtggttaagcgcgagcatattcgtttacgcgtttatgagcgtggggcaggagaaacccaggcctgcggcagcggcgcgtgtgcggcggttgcagtagggattcagcaaggtttgctggccgaagaagtacgcgtggaactccccggcggtcgtcttgatatcgcctggaaaggtccgggtcacccgttatatatgactggcccggcggtacatgtctacgacggatttattcatctatga

SEQ ID NO: 47312 - DNA, 2163 bp, Escherichia coli
atggacgtttcttacctgctcgacagccttaatgacaaacagcgcgaagcggtggccgcgccacgcagcaaccttctggtgctggcgggcgcgggcagtggtaagacgcgcgtactggtgcatcgtatcgcctggttgatgagcgtggaaaactgctcgccatactcgattatggcggtgacgtttaccaacaaagcggcggcggagatgcgtcatcgtatcgggcaactgatgggcacgagccagggcggtatgtgggtcggcaccttccacgggctggcgcaccgtttgctgcgtgcgcaccatatggacgccaatctgccgcaggatttccagatcctcgacagtgaagaccagctacgcctgcttaagcgtctgatcaaagccatgaacctcgacgagaagcagtggccgccgcggcaggcaatgtggtacatcaacagccagaaagatgaaggcctgcgtccgcatcatattcaaagctacggtaatccggtggagcagacctggcagaaggtgtatcaggcgtatcaggaagcgtgtgaccgcgcgggcctggtggacttcgccgagctgctgctgcgcgctcacgagttgtggcttaacaagccgcatatcctgcaacactaccgcgaacgttttaccaatatcctggtggacgaattccaggataccaacaacattcagtacgcgtggatccgcctgctggcgggcgacaccggcaaagtgatgatcgtcggtgatgacgaccagtcaatctacggctggcgcggggcgcaggtggagaatattcagcgtttccttaatgatttccccggtgccgaaactattcgtctggagcaaaactaccgctctaccagcaatattctgagcgccgctaacgccctgattgaaaacaataacgggcgtctgggtaaaaaactgtggaccgatggcgcggacggtgagcctatttccctctattgcgcttttaacgaactcgatgaagcgcgttttgtggttaaccgcatcaaaacctggcaggacaacggcggagcgcttgccgagtgcgccattctctaccgcagcaacgcccagtcgcgggtgctcgaagaggcgttattgcaggccagtatgccgtaccgtatttacggcgggatgcgcttcttcgaacgccaggaaatcaaagatgcgctctcgtatctgcgcctgattgccaaccgcaacgacgacgcggcctttgagcgtgtggtgaatacgccaacgcggggtattggtgaccggacgctggacgtggtacgtcagacatcgcgcgatcgccagttaacactctggcaggcatgtcgtgagctgttgcaggaaaaagccctcgccgggcgagctgccagcgccttgcagcgatttatggaattaatcgacgccttagcgcaggaaactgccgatatgccgctgcatgtacagactgaccgggtaattaaagactccggcctgcgtaccatgtatgagcaggagaagggcgaaaaaggtcagacgcgtatcgaaaacttagaggaactggtgacggcaacgcgccagttcagctacaacgaagaagacgaagatttaatgccgctgcaggcgttcctctcccatgcggcactggaagcaggtgaagggcaggcggatacctggcaggatgcggtgcagttgatgacgctacactcggcgaaaggcctggagttcccgcaggtgtttatcgttggtatggaagagggcatgttcccaagccagatgtcgctggatgaaggcgggcgtctggaagaagaacgccgtctggcctacgttggcgtaacccgcgcgatgcagaaactgacgctgacctacgcggaaacccgccgtctgtatggtaaagaggtttaccatcgcccgtcgcgctttatcggcgagctgccggaagagtgtgtggaagaggtgcgcctgcgcgccacggtaagccgcccggtcagccatcagcggatgggtacgccgatggtcgagaacgacagcggctacaagctcggccagcgcgtacgccacgctaagtttggtgaaggcaccattgtcaatatggaaggcagcggtgagcatagccgtttgcaggtggcatttcagggccagggtattaaatggctggtggcggcatacgcccggctggagtcggtgtaa

SEQ ID NO: 47313 - DNA, 870 bp, Escherichia coli
atgcggactctgcagggctggttgttgccggtgtttatgttgcctatggcagtatatgcacaagaggcaacggtgaaagaggtgcatgacgcgccagcggtgcgtggcagtattatcgccaatatgctgcaggagcatgacaatccgttcacgctctatccttatgacaccaactacctcatttacacccaaaccagcgatctgaataaagaagcgattgccagttacgactgggcggaaaatgcgcgtaaggatgaagtaaagtttcagttgagcctggcatttccgctgtggcgtgggattttaggcccgaactcggtgttgggtgcgtcttatacgcaaaaatcctggtggcaactgtccaatagcgaagagtcttcaccgtttcgtgaaaccaactacgaaccgcaattgttcctcggttttgccaccgattaccgttttgcaggttggacgctgcgcgatgtggagatggggtataaccacgactctaacgggcgttccgacccgacctcccgcagctggaaccgcctttatactcgcctgatggcagaaaacggtaactggctggtagaagtgaagccgtggtatgtggtgggtaatactgacgataacccggatatcaccaaatatatgggttactaccagcttaaaatcggctatcacctcggtgatgcggtgctcagtgcgaaaggacagtacaactggaacaccggctacggcggcgcggagttaggcttaagttacccgatcaccaaacatgtgcgcctttatactcaggtttacagcggctatggcgaatcgctcatcgactataacttcaaccagacccgtgtcggtgtgggggttatgctaaacgatttgttttga

SEQ ID NO: 47314 - DNA, 1023 bp, Escherichia coli
atgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagctacgtaaaatatgcggaactggcctatgacctgttccatttggggtttgatgtcttaatcatcgaccatcgcgggcagggacgttccggtcgcctgttagccgatccgcatctcgggcatgttaatcgctttaatgattatgttgatgatctggcggcattctggcagcaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgccaacgcttctcttgcaggctgaagaggaacgcgtggtggataaccgcatgcatgaccgtttttgtgaactccgcaccgccgcgggccatcctgtcgaaggaggacggccgttggtaattaaaggtgcttaccatgagatcctttttgaaaaggacgcaatggcctcagtcgcgctccacgccatcgttgattttttcaacaggcataactcacccagcggaaaccgctctacagaggtttaa

SEQ ID NO: 47315 - DNA, 2262 bp, Escherichia coli
atgacaatattgaatcacaccctcggtttccctcgcgttggcctgcgtcgcgagctgaaaaaagcgcaagaaagttattgggcggggaactccacgcgtgaagaactgctggcggtagggcgtgaattgcgtgctcgtcactgggatcaacaaaagcaagcgggtatcgacctgctgccggtgggcgattttgcctggtacgatcatgtactgaccaccagtctgctgctgggtaacgttccggcgcgtcatcagaacaaagatggttcggtagatatcgacaccctgttccgtattggtcgtggacgtgcgccgactggcgaacctgcggcggcagcggaaatgaccaaatggtttaacaccaactatcactacatggtgccggagttcgttaaaggccaacagttcaaactgacctggacgcagctgctggacgaagtggacgaggcgctggcgctgggccacaaggtgaaacctgtgctgctggggccggttacctggctgtggctggggaaagtgaaaggtgaacaatttgaccgcctgagcctgctgaacgacattctgccggtttatcagcaagtgctggcagaactggcgaaacgcggcatcgagtgggtacagattgatgaacccgcgctggtactggaactaccacaggcgtggctggacgcatacaaacccgcttacgacgcgctccagggacaggtgaaactgctgctgaccacctattttgaaggcgtaacgccaaatctcgacacgattactgcgctgcctgttcagggtctgcatgttgacctcgtacatggtaaagatgacgttgctgaactgcacaagcgcctgccttctgactggttgctgtctgcgggtctgatcaatggtcgtaacgtctggcgcgccgatcttaccgagaaatatgcgcaaattaaggacattgtcggcaaacgtgatttgtgggtggcatcttcctgctcgttgctgcacagccccatcgacctgagcgtggaaacgcgtcttgatgcagaagtgaaaagctggtttgccttcgccctacaaaaatgccatgaactggcactgctgcgcgatgcgctgaacagtggtgacacggcagctctggcagagtggagcgccccgattcaggcacgtcgtcactctacccgcgtacataatccggcggtagaaaagcgtctggcggcgatcaccgcccaggacagccagcgtgcgaatgtctatgaagtgcgtgctgaagcccagcgtgcgcgttttaaactgccagcgtggccgaccaccacgattggttccttcccgcaaaccacggaaattcgtaccctgcgtctggatttcaaaaagggcaatctcgacgccaacaactaccgcacgggcattgcggaacatatcaagcaggccattgttgagcaggaacgtttgggactggatgtgctggtacatggcgaggccgagcgtaatgacatggtggaatactttggcgagcacctcgacggatttgtctttacgcaaaacggttgggtacagagctacggttcccgctgcgtgaagccaccgattgtcattggtgacattagccgcccggcaccgattaccgtggagtgggcgaagtatgcgcaatcgctgaccgacaaaccggtgaaagggatgctgacggggccggtgaccatactctgctggtcgttcccgcgtgaagatgtcagccgtgaaaccatcgccaaacagattgcgctggcgctgcgtgatgaagtggccgatctggaagccgctggaattggcatcatccagattgacgaaccggcgctgcgcgaaggtttaccgctgcgtcgtagcgactgggatgcgtatctccagtggggcgtagaggccttccgtatcaacgccgccgtggcgaaagatgacacacaaatccacactcacatgtgttattgcgagttcaacgacatcatggattcgattgcggcgctggacgcagacgtcatcaccatcgaaacctcgcgttccgacatggagttgctggagtcgtttgaagagtttgattatccaaatgaaatcggtcctggcgtctatgacattcactcgccaaacgtaccgagcgtggaatggattgaagccttgctgaagaaagcggcaaaacgcattccggcagagcgcctgtgggtcaacccggactgtggcctgaaaacgcgcggctggccagaaacccgcgcggcactggcgaacatggtgcaggcggcgcagaacttgcgtcgggggtaa

SEQ ID NO: 47316 - DNA, 1641 bp, Escherichia coli
atgacgccaggtgaagtacggcgcctatatttcatcattcgcacttttttaagctacggacttgatgaactgatccccaaaatgcgtatcaccctgccgctacggctatggcgatactcattattctggatgccaaatcggcataaagacaaacttttaggtgagcgactacgactggccctgcaagaactggggccggtttggatcaagttcgggcaaatgttatcaacccgccgcgatctttttccaccgcatattgccgatcagctggcgttattgcaggacaaagttgctccgtttgatggcaagctggcgaagcagcagattgaagctgcaatgggcggcttgccggtagaagcgtggtttgacgattttgaaatcaagccgctggcttctgcttctatcgcccaggttcataccgcgcgattgaaatcgaatggtaaagaggtggtgattaaagtcatccgcccggatattttgccggttattaaagcggatctgaaacttatctaccgtctggctcgctgggtgccgcgtttgctgccggatggtcgccgtctgcgcccaaccgaagtggtgcgcgagtacgaaaagacattgattgatgaactgaatttgctgcgggaatctgccaacgccattcagcttcggcgcaattttgaagacagcccgatgctctacatcccggaagtttaccctgactattgtagtgaagggatgatggtgatggagcgcatttacggcattccggtgtctgatgttgcggcgctggagaaaaacggcactaacatgaaattgctggcggaacgcggcgtgcaggtgttcttcactcaggtctttcgcgacagctttttccatgccgatatgcaccctggcaacatcttcgtaagctatgaacacccggaaaacccgaaatatatcggcattgattgcgggattgttggctcgctaaacaaagaagataaacgctatctggcagaaaactttatcgccttctttaatcgcgactatcgcaaagtggcagagctacacgtcgattctggctgggtgccaccagataccaacgttgaagagttcgaatttgccattcgtacggtctgtgaacctatctttgagaaaccgctggccgaaatttcgtttggacatgtactgttaaatctgtttaatacggcgcgtcgcttcaatatggaagtgcagccgcaactggtgttactccagaaaaccctgctctacgtcgaaggggtaggacgccagctttatccgcaactcgatttatggaaaacggcgaagcctttcctggagtcgtggattaaagatcaggtcggtattcctgcgctggtgagagcatttaaagaaaaagcgccgttctgggtcgaaaaaatgccagaactgcctgaattggtttacgacagtttgcgccagggcaagtatttacagcacagtgttgataagattgcccgcgagcttcagtcaaatcatgtacgtcagggacaatcgcgttattttctcggaattggcgctacgttagtattaagtggcacattcttgttggtcagccgacctgaatgggggctgatgcccggctggttaatggcaggtggtctgatcgcctggtttgtcggttggcgcaaaacacgctga

SEQ ID NO: 47317 - DNA, 702 bp, Escherichia coli
atgacaaccttaagctgtaaagtgacctcggtagaagctatcacggataccgtatatcgtgtccgcatcgtgccagacgcggccttttcttttcgtgctggtcagtatttgatggtagtgatggatgagcgcgacaaacgtccgttctcaatggcttcgacgccggatgaaaaagggtttatcgagctgcatattggcgcttctgaaatcaacctttacgcgaaagcagtcatggaccgcatcctcaaagatcatcaaatcgtggtcgacattccccacggagaagcgtggctgcgcgatgatgaagagcgtccgatgattttgattgcgggcggcaccgggttctcttatgcccgctcgattttgctgacagcgttggcgcgtaacccaaaccgtgatatcaccatttactggggcgggcgtgaagagcagcatctgtatgatctctgcgagcttgaggcgctttcgttgaagcatcctggtctgcaagtggtgccggtggttgaacaaccggaagcgggctggcgtgggcgtactggcaccgtgttaacggcggtattgcaggatcacggtacgctggcagagcatgatatctatattgccggacgttttgagatggcgaaaattgcccgcgatctgttttgcagtgagcgtaatgcgcgggaagatcgcctgtttggcgatgcgtttgcatttatctga

SEQ ID NO: 47318 - DNA, 1164 bp, Escherichia coli
atggaacaggttgtcattgtcgatgcaattcgcaccccgatgggccgttcgaagggcggtgcttttcgtaacgtgcgtgcagaagatctctccgctcatttaatgcgtacgctgctggcgcgtaacccggcgctggaagcggcggccctcgacgatatttactggggttgtgtgcagcagacgctggagcagggttttaatatcgcccgtaacgcggcgctgctggcagaagtaccacactctgtcccggcggttaccgttaatcgcttgtgtggttcatccatgcaggcactgcatgacgcagcacgaatgatcatgactggcgatgcgcaggcatgtctggttggcggcgtggagcatatgggccatgtgccgatgagtcacggcgtcgattttcaccccggcctgagccgcaatgtcgccaaagcggcgggcatgatgggcttaacggcagaaatgctggcgcgtatgcacggtatcagccgtgaaatgcaggatgcctttgccgcgcggtcacacgcccgcgcctgggccgccacgcagtcggccgcatttaaaaatgaaatcatcccgaccggtggtcacgatgccgacggcgtcctgaagcagtttaattacgacgaagtgattcgcccggaaaccaccgtggaagccctcgccacgctgcgtccggcgtttgatccagtaaacggtatggtaacggcgggcacatcttctgcactttccgatggcgcagctgccatgctggtgatgagtgaaagccgcgcccatgaattaggtcttaagccgcgcgctcgtgtgcgttcgatggcggtcgttggttgtgacccatcgattatgggttacggcccggttccggcctcgaaactggcgctgaaaaaagcggggctttctgccagcgatatcggcgtgtttgaaatgaacgaagcctttgccgcgcagatcctgccatgtattaaagatctgggactaattgagcagattgacgagaagatcaacctcaacggtggcgcgatcgcgctgggtcatccgctgggttgttccggtgcgcgtatcagcaccacgctgctgaatctgatggaacgcaaagacgttcagtttggtctggcgacgatgtgtatcggtctgggtcagggtattgcgacggtgtttgagcgggtttaa

SEQ ID NO: 47319 - DNA, 2190 bp, Escherichia coli
atgctttacaaaggcgacaccctgtaccttgactggctggaagatggcattgccgaactggtatttgatgccccaggttcagttaataaactcgacactgcgaccgtcgccagcctcggcgaggccatcggcgtgctggaacagcaatcagatctaaaagggctgctgctgcgttcgaacaaagcagcctttatcgtcggtgctgatatcaccgaatttttgtccctgttcctcgttcctgaagaacagttaagtcagtggctgcactttgccaatagcgtgtttaatcgcctggaagatctgccggtgccgaccattgctgccgtcaatggctatgcgctgggcggtggctgcgaatgcgtgctggcgaccgattatcgtctggcgacgccggatctgcgcatcggtctgccggaaaccaaactgggcatcatgcctggctttggcggttctgtacgtatgccacgtatgctgggcgctgacagtgcgctggaaatcattgccgccggtaaagatgtcggcgcggatcaggcgctgaaaatcggtctggtggatggcgtagtcaaagcagaaaaactggttgaaggcgcaaaggcggttttacgccaggccattaacggcgacctcgactggaaagcaaaacgtcagccgaagctggaaccactaaaactgagcaagattgaagccaccatgagcttcaccatcgctaaagggatggtcgcacaaacagcggggaaacattatccggcccccatcaccgcagtaaaaaccattgaagctgcggcccgttttggtcgtgaagaagccttaaacctggaaaacaaaagttttgtcccgctggcgcataccaacgaagcccgcgcactggtcggcattttccttaacgatcaatatgtaaaaggcaaagcgaagaaactcaccaaagacgttgaaaccccgaaacaggccgcggtgctgggtgcaggcattatgggcggcggcatcgcttaccagtctgcgtggaaaggcgtgccggttgtcatgaaagatatcaacgacaagtcgttaaccctcggcatgaccgaagccgcgaaactgctgaacaagcagcttgagcgcggcaagatcgatggtctgaaactggctggcgtgatctccacaatccacccaacgctcgactacgccggatttgaccgcgtggatattgtggtagaagcggttgttgaaaacccgaaagtgaaaaaagccgtactggcagaaaccgaacaaaaagtacgccaggataccgtgctggcgtctaacacttcaaccattcctatcagcgaactggccaacgcgctggaacgcccggaaaacttctgcgggatgcacttctttaacccggtccaccgaatgccgttggtagaaattattcgcggcgagaaaagctccgacgaaaccatcgcgaaagttgtcgcctgggcgagcaagatgggcaagacgccgattgtggttaacgactgccccggcttctttgttaaccgcgtgctgttcccgtatttcgccggtttcagccagctgctgcgcgacggcgcggatttccgcaagatcgacaaagtgatggaaaaacagtttggctggccgatgggcccggcatatctgctggacgttgtgggcattgataccgcgcatcacgctcaggctgtcatggcagcaggcttcccgcagcggatgcagaaagattaccgcgatgccatcgacgcgctgtttgatgccaaccgctttggtcagaagaacggcctcggtttctggcgttataaagaagacagcaaaggtaagccgaagaaagaagaagacgccgccgttgaagacctgctggcagaagtgagccagccgaagcgcgatttcagcgaagaagagattatcgcccgcatgatgatcccgatggtcaacgaagtggtgcgctgtctggaggaaggcattatcgccactccggcggaagcggatatggcgctggtctacggcctgggcttccctccgttccacggcggcgcgttccgctggctggacaccctcggtagcgcaaaatacctcgatatggcacagcaatatcagcacctcggcccgctgtatgaagtgccggaaggtctgcgtaataaagcgcgtcataacgaaccgtactatcctccggttgagccagcccgtccggttggcgacctgaaaacggcttaa

SEQ ID NO: 47320 - DNA, 1332 bp, Escherichia coli
atggaatcactggcctcgctctataaaaatcatatagctaccttacaagaacggactcgcgatgcgctggcgcgcttcaagctggatgcgttacttattcactccggcgagctgttcaatgtttttctcgacgatcatccctatccgtttaaagtgaacccgcaattcaaagcgtgggtgccggtaactcaggtgccaaactgctggttgctggtggatggcgtgaacaagccgaaactgtggttctatctgccggttgattactggcacaacgtcgaaccgctgccgacctctttctggactgaagatgtggaagtgatcgcgctgccgaaagccgatggcattggtagcctgctgcctgctgcgcgcggcaatatcggttatatcggtccggtgccggaacgtgcgctgcaactgggtattgaggccagcaacatcaacccgaaaggggttatcgactacctgcattactatcgctccttcaaaactgagtacgaactggcctgtatgcgtgaagcgcagaaaatggcggtcaacggtcaccgcgcggcagaagaagcgttccgttctggcatgagcgagttcgatatcaacattgcctatctgaccgcgaccggtcatcgtgataccgacgtaccttacagcaacattgtggcgcttaacgaacacgctgcggtactgcattacaccaaactggaccatcaggcaccggaagagatgcgcagcttcctgctggatgccggggcagaatataacggctatgcggctgacctgacccgtacctggtcggcaaaaagtgacaacgactacgcgcagctggtgaaggacgttaatgatgaacaactggcgctgatcgccaccatgaaagcaggcgtcagctatgtggattaccacatccagttccatcagcgcatcgccaaactgctgcgtaaacatcaaatcatcaccgatatgagtgaagaagcgatggtcgaaaacgatcttaccgggccgtttatgccgcatggtatcggccatccgctgggcctgcaggtgcatgacgtcgctggttttatgcaggatgatagcggtacgcacctcgcggcaccggcaaaatatccgtacctgcgctgcacccgtattctccagccgggcatggtgttaaccatcgaaccgggtatctacttcatcgaatcgctactggcaccgtggcgtgaagggcagttcagcaagcacttcaactggcagaaaattgaagcactgaaaccgttcggcggcattcgtatcgaagacaacgtggtgatccacgaaaacaacgtggaaaacatgacccgggatctgaaactggcgtga

SEQ ID NO: 47321 - DNA, 546 bp, Escherichia coli
gtgaaaacattaattcttttctcaacaagggacggacaaacgcgcgagattgcctcctacctggcttcggaactgaaagaactggggatccaggcggatgtcgccaatgtgcaccgcattgaagaaccacagtgggaaaactatgaccgtgtggtcattggtgcttctattcgctatggtcactaccattcagcgttccaggaatttgtcaaaaaacatgcgacgcggctgaattcgatgccgagcgccttttactccgtgaatctggtggcgcgcaaaccggagaagcgtactccacagaccaacagctacgcgcgcaagtttctgatgaactcgcaatggcgtcccgatcgctgcgcggtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaataa

SEQ ID NO: 47322 - DNA, 903 bp, Escherichia coli
atgaccatgattcgtgttgcttgtgtaggtataaccgtgatggatcgcatctattacgtggaagggttaccgacggagagcggtaaatacgtggcgagaaattatacggaagttggtggcgggccagcggcgacggcagcggttgcggcggcaaggctgggggcgcaggtcgattttattggtcgcgtaggtgatgacgacacgggcaacagcctgctggcagagctggaatcctggggcgttaacacccgttacaccaaacggtataaccaggcgaaatcttcgcaatccgccatcatggtggataccaaaggcgagcggataatcattaactaccccagcccggatctgctgcctgacgcagagtggttggaggaaattgatttctctcagtgggatgttgtgctggcagatgtacgctggcacgacggcgctaaaaaagccttcaccctggcccgtcaggcgggtgtgatgaccgttctggacggggacattacgccgcaggatatcagtgagctggtggcattaagcgatcacgcggccttttcagaaccgggtctggcgcgcttaacgggcgtgaaagagatggccagtgcgctaaaacaggcacaaacgctcacaaatggtcatgtctatgtgacccagggtagcgcaggctgcgactggctggaaaatggtgggcgtcagcatcaaccggccttcaaagttgatgtggtagataccacaggtgcgggtgatgtttttcacggcgctttggcggtggcgctggcaacaagtggggatttagcggagtcagtccgcttcgccagcggtgtagcggcgttaaaatgcacacgtcccggtggacgagccgggatccctgactgtgatcaaacccgatcttttttgtcactttttgtataa

SEQ ID NO: 47323 - DNA, 3051 bp, Escherichia coli
atgcaggtcagcagaaggcagttctttaagatctgcgctggcggtatggcaggcaccacggcagcggcactgggttttgcacccagcgtagcactcgcggaaacccggcagtataaactgctgcgcacccgcgaaacccgtaatacctgcacctattgttccgtaggctgtgggctgttgatgtacagcctcggtgacggagcaaaaaacgccaaagcatctatcttccatatcgaaggcgatccggatcacccggtcaaccgcggtgcactttgtccgaaaggcgctggcctggtggatttcatccactccgaaagccgtctgaagtttccggaataccgtgcgccaggttctgataaatggcagcaaatcagttgggaagaggcgtttgatcgcatcgccaaactgatgaaagaagaccgcgatgctaactacattgcgcaaaacgccgaaggcgtgactgttaaccgctggctctccaccgggatgctgtgtgcttccgcgtcgagtaacgaaaccggctatttaacgcaaaaattctcccgcgcgctgggtatgctcgcggtcgacaaccaggcgcgtgtctgacacggaccaacggtagcaagtcttgctccaacatttggtcgcggtgcgatgaccaaccactgggtcgacatcaagaacgccaacctcgtcgtggtgatgggcggtaacgccgctgaagctcacccggtcgggttccgctgggcgatggaagccaaaattcacaacggcgcgaagctgattgtgatcgatcctcgctttacgcgtacggcggcggtagctgactactatgcccctattcgttccggtactgacattgctttcctgtcaggcgtattgctgtacctgctgaacaatgaaaaattcaaccgcgaatacaccgaagcctataccaacgccagcctgatcgtgcgtgaggattacggctttgaagatggcctgttcaccggctacgacgcggaaaaacgcaagtacgataaatcctcctggacttatgaactggacgaaaacggcttcgccaaacgcgataccacgctgcaacatccgcgctgcgtgtggaacttgctgaaacagcacgtttcccgctacacgccagatgtggttgaaaacatctgtggtacgccaaaagacgcgttcctgaaagtctgcgaatacatcgcagaaaccagtgctcacgataaaactgcctcgttcctgtatgccctcggctggacgcaacactccgttggtgcgcaaaacattcgtacgatggcgatgatccagctgctgctcggcaatatggggatggcaggcggcggcgttaacgccctgcgcggtcactccaatattcaggggctgacggacctggggctgctgtcgcagagcctgccaggttacatgacgctgccaagcgagaagcagaccgatctgcaaacctaccttaccgccaacacgccaaaaccgctgctggaaggccaggtaaactactggggcaactacccgaaattcttcgtctctatgatgaaggccttctttggtgataaagcgacggcggaaaatagctggggctttgactggttgccgaagtgggataaaggctacgacgtcctgcaatacttcgagatgatgaaagagggcaaggtcaatggctatatctgccagggctttaaccctgttgcctcattcccgaacaaaaacaaagtgatcggttgtctgtcgaaactgaagttcctcgtcaccatcgacccactgaacactgaaacctctaacttctggcagaaccacggtgagctgaacgaagttgactcgtcgaagatccagaccgaagtgttccgtctgccatcgacctgcttcgcggaagagaacggttctatcgttaactcaggtcgctggttacagtggcactggaaaggtgcggacgccccggggattgcgctgactgacggcgagatcctctccggtatcttcctgcgcttgcgcaagatgtatgccgaacagggtggcgcgaacccggaccaggtgctgaacatgacatggaactacgccattccgcatgagccatcttcagaagaagtggcgatggagagcaacggtaaggcgctggccgatattaccgatccggcaaccggtgcggttatcgtcaagaaaggccaacaacttagttcgttcgcccaattgcgcgatgacggtacaacctcctgtggctgctggattttcgccggtagctggacgccggaaggcaaccagatggcacgccgtgataacgccgatccgtctggcctcggtaacacgctgggctgggcatgggcatggccgcttaaccgccgcattctgtataaccgcgcctccgcagatccgcagggtaacccgtgggatccgaagcgtcagttgctgaaatgggacggcactaagtggaccggctgggatattccggactacagcgcagcgcctccgggtagcggcgtcgggccgtttatcatgcagcaggaaggcatggggcgtctgtttgccctcgataagatggcggaaggtccgttcccggaacactacgagccgtttgaaacgccgctgggaactaacccgctgcatccaaacgttatctcgaacccggctgcacgtatctttaaagacgacgccgaagcattgggtaaagccgataagttcccgtatgtcggaaccacctatcgtctgaccgagcacttccactactggaccaaacacgcgctgttgaacgcgattttgcagccagagcagtttgtggaaatcggggagtcgctggcgaataaacttggcattgcccagggcgataccgtgaaagtctcctccaaccgtggctatatcaaagccaaagcggtggtgaccaaacgtattcgcacgctgaaagcgaacggcaaagatatcgataccatcggtattccgattcactggggctatgaaggcgtagctaaaaaaggctttattgccaatactttaacgccattcgttggtgatgcgaacacgcagacgccggagtttaagtccttccttgtgaatgtggaaaaggtgtaa

SEQ ID NO: 47324 - DNA, 1470 bp, Escherichia coli
atgacctttcgcaattgtgtcgccgtcgatctcggcgcatccagtgggcgcgtgatgctggcgcgttacgagcgtgaatgccgcagcctgacgctgcgcgaaatccatcgttttaacaatgggctgcatagtcagaacggctatgtcacctgggatgtggatagccttgaaagtgccattcgccttggattaaacaaggtgtgcgaggaagggattcgtatcgatagcattgggattgatacctggggcgtggactttgtgctgctcgaccaacagggtcagcgtgtgggcctgcccgttgcttatcgcgatagccgcaccaatggcctaatggcgcaggcacaacaacaactcggcaaacgcgatatttatcaacgtagcggcatccagtttctgcccttcaatacgctttatcagttgcgtgcgctgacggagcaacaacctgaacttattccacacattgctcacgctctgctgatgccggattacttcagttatcgcctgaccggcaagatgaactgggaatataccaacgccacgaccacgcaactggtcaatatcaatagcgacgactgggacgagtcgctactggcgtggagcggggccaacaaagcctggtttggtcgcccgacgcatccgggtaatgtcataggtcactggatttgcccgcagggtaatgagattccagtggtcgccgttgccagccatgataccgccagcgcggttatcgcctcgccgttaaacggctcacgtgctgcttatctctcttctggcacctggtcattgatgggcttcgaaagccagacgccatttaccaatgacacggcactggcagccaacatcaccaatgaaggcggggcggaaggtcgctatcgggtgctgaaaaatattatgggcttatggctgcttcagcgagtgcttcaggagcagcaaatcaacgatcttccggcgcttatctccgcgacacaggcacttccggcttgccgcttcattatcaatcccaatgacgatcgctttattaatcctgagacgatgtgcagcgaaattcaggctgcgtgtcgggaaacggcgcaaccgatcccggaaagtgatgctgaactggcgcgctgcattttcgacagtctggcgctgctgtatgccgatgtgttgcatgagctggcgcagctgcgcggtgaagatttctcgcaactgcatattgtcggcggaggctgccagaacacgctgctcaaccagctatgcgccgatgcctgcggtattcgggtgatcgccgggcctgttgaagcctcgacgctcggcaatatcggcatccagttaatgacgctggatgaactcaacaatgtggatgatttccgtcaggtcgtcagcaccaccgcgaatctgaccacctttacccctaatcctgacagtgaaattgcccactatgtggcgcagattcactctacacgacagacaaaggagctttgcgcatga

SEQ ID NO: 47325 - DNA, 963 bp, Escherichia coli
atgattaagaaaatcggtgtgttgacaagcggcggtgatgcgccaggcatgaacgccgcaattcgcggggttgttcgttctgcgctgacagaaggtctggaagtaatgggtatttatgacggctatctgggtctgtatgaagaccgtatggtacagctagaccgttacagcgtgtctgacatgatcaaccgtggcggtacgttcctcggttctgcgcgtttcccggaattccgcgacgagaacatccgcgccgtggctatcgaaaacctgaaaaaacgtggtatcgacgcgctggtggttatcggcggtgacggttcctacatgggtgcaatgcgtctgaccgaaatgggcttcccgtgcatcggtctgccgggcactatcgacaacgacatcaaaggcactgactacactatcggtttcttcactgcgctgagcaccgttgtagaagcgatcgaccgtctgcgtgacacctcttcttctcaccagcgtatttccgtggtggaagtgatgggccgttattgtggagatctgacgttggctgcggccattgccggtggctgtgaattcgttgtggttccggaagttgaattcagccgtgaagacctggtaaacgaaatcaaagcgggtatcgcgaaaggtaaaaaacacgcgatcgtggcgattaccgaacatatgtgtgatgttgacgaactggcgcatttcatcgagaaagaaaccggtcgtgaaacccgcgcaactgtgctgggccacatccagcgcggtggttctccggtgccttacgaccgtattctggcttcccgtatgggcgcttacgctatcgatctgctgctggcaggttacggcggtcgttgtgtaggtatccagaacgaacagctggttcaccacgacatcatcgacgctatcgaaaacatgaagcgtccgttcaaaggtgactggctggactgcgcgaaaaaactgtattaa

SEQ ID NO: 47326 - DNA, 768 bp, Escherichia coli
atgcgacatcctttagtgatgggtaactggaaactgaacggcagccgccacatggttcacgagctggtttctaacctgcgtaaagagctggcaggtgttgctggctgtgcggttgcaatcgcaccaccggaaatgtatatcgatatggcgaagcgcgaagctgaaggcagccacatcatgctgggtgcgcaaaacgtggacctgaacctgtccggcgcattcaccggtgaaacctctgctgctatgctgaaagacatcggcgcacagtacatcatcatcggtcactctgaacgtcgtacttaccacaaagaatctgacgaactgatcgcgaaaaaattcgcggtgctgaaagagcagggcctgactccggttctgtgcatcggtgaaaccgaagctgaaaatgaagcgggcaaaactgaagaagtttgcgcacgtcagatcgacgcggtactgaaaactcagggtgctgcggcattcgaaggtgcggttatcgcttacgaacctgtatgggcaatcggtactggcaaatctgcaactccggctcaggcacaggctgttcacaaattcatccgtgaccacatcgctaaagttgacgctaacatcgctgaacaagtgatcattcagtacggcggctctgtaaacgcgtctaacgctgcagaactgtttgctcagccggatatcgacggcgcgctggttggtggtgcttctctgaaagctgacgccttcgcagtaatcgttaaagctgcagaagcggctaaacaggcttaa

SEQ ID NO: 47327 - DNA, 1509 bp, Escherichia coli
atgactgaaaaaaaatatatcgttgcgctcgaccagggcaccaccagctcccgcgcggtcgtaatggatcacgatgccaatatcattagcgtgtcgcagcgcgaatttgagcaaatctacccaaaaccaggttgggtagaacacgacccaatggaaatctgggccacccaaagctccacgctggtagaagtgctggcgaaagccgatatcagttccgatcaaattgcagctatcggtattacgaaccagcgtgaaaccactattgtctgggaaaaagaaaccggcaagcctatctataacgccattgtctggcagtgccgtcgtaccgcagaaatctgcgagcatttaaaacgtgacggtttagaagattatatccgcagcaataccggtctggtgattgacccgtacttttctggcaccaaagtgaagtggatcctcgaccatgtggaaggctctcgcgagcgtgcacgtcgtggtgaattgctgtttggtacggttgatacgtggcttatctggaaaatgactcagggccgtgtccatgtgaccgattacaccaacgcctctcgtaccatgttgttcaacatccataccctggactgggacgacaaaatgctggaagtgctggatattccgcgcgagatgctgccagaagtgcgtcgttcttccgaagtatacggtcagactaacattggcggcaaaggcggcacgcgtattccaatctccgggatcgccggtgaccagcaggccgcgctgtttggtcagttgtgcgtgaaagaagggatggcgaagaacacctatggcactggctgctttatgctgatgaacactggcgagaaagcggtgaaatcagaaaacggcctgctgaccaccatcgcctgcggcccgactggcgaagtgaactatgcgttggaaggtgcggtgtttatggcaggcgcatccattcagtggctgcgcgatgaaatgaagttgattaacgacgcctacgattccgaatatttcgccaccaaagtgcaaaacaccaatggtgtgtatgtggttccggcatttaccgggctgggtgcgccgtactgggacccgtatgcgcgcggggcgattttcggtctgactcgtggggtgaacgctaaccacattatacgcgcgacgctggagtctattgcttatcagacgcgtgacgtgctggaagcgatgcaggccgactctggtatccgtctgcacgccctgcgcgtggatggtggcgcagtagcaaacaatttcctgatgcagttccagtccgatattctcggcacccgcgttgagcgcccggaagtgcgcgaagtcaccgcattgggtgcggcctatctcgcaggcctggcggttggcttctggcagaacctcgacgagctgcaagagaaagcggtgattgagcgcgagttccgtccaggcatcgaaaccactgagcgtaattaccgttacgcaggctggaaaaaagcggttaaacgcgcgatggcgtgggaagaacacgacgaataa

SEQ ID NO: 47328 - DNA, 1161 bp, Escherichia coli
atgacgcgtaaacaggccaccatcgcagtgcgtagcgggttaaatgacgacgaacagtatggttgcgttgtcccaccgatccatctttccagcacctataactttaccggatttaatgaaccgcgcgcgcatgattactcgcgtcgcggcaacccaacgcgcgatgtggttcagcgtgcgctggcagaactggaaggtggtgctggtgcagtacttactaataccggcatgtccgcgattcacctggtaacgaccgtctttttgaaacctggcgatctgctggttgcgccgcacgactgctacggcggtagctatcgcctgttcgacagtctggcgaaacgcggttgctatcgcgtgttgtttgttgatcaaggcgatgaacaggcattacgggcagcgctggcagaaaaacccaaactggtactggtagaaagcccaagtaatccattgttacgcgtcgtggatattgcgaaaatctgccatctggcaagggaagtcggggcggtgagcgtggtggataacaccttcttaagcccggcattacaaaatccgctggcattaggtgccgatctggtgttgcattcatgcacgaaatatctgaacggtcactcagacgtagtggccggcgtggtgattgctaaagacccggacgttgtcactgaactggcctggtgggcaaacaatattggcgtgacgggcggcgcgtttgacagctatctgctgctacgtgggttgcgaacgctggtgccgcgtatggagctggcgcagcgcaacgcgcaggcgattgtgaaatacctgcaaacccagccgttggtgaaaaaactgtatcacccgtcgttgccggaaaatcaggggcatgaaattgccgcgcgccagcaaaaaggctttggcgcaatgttgagttttgaactggatggcgatgagcagacgctgcgtcgtttcctgggcgggctgtcgttgtttacgctggcggaatcattagggggagtggaaagtttaatctctcacgccgcaaccatgacacatgcaggcatggcaccagaagcgcgtgctgccgccgggatctccgagacgctgctgcgtatctccaccggtattgaagatggcgaagatttaattgccgacctggaaaatggcttccgggctgcaaacaaggggtaa

SEQ ID NO: 47329 - DNA, 2433 bp, Escherichia coli
atgagtgtgattgcgcaggcaggggcgaaaggtcgtcagctgcataaatttggtggcagtagtctggctgatgtgaagtgttatttgcgtgtcgcgggcattatggcggagtactctcagcctgacgatatgatggtggtttccgccgccggtagcaccactaaccagttgattaactggttgaaactaagccagaccgatcgtctctctgcgcatcaggttcaacaaacgctgcgtcgctatcagtgcgatctgattagcggtctgctacccgctgaagaagccgatagcctcattagcgcttttgtcagcgaccttgagcgcctggcggcgctgctcgacagcggtattaacgacgcagtgtatgcggaagtggtgggccacggggaagtatggtcggcacgtctgatgtctgcggtacttaatcaacaagggctgccagcggcctggcttgatgcccgcgagtttttacgcgctgaacgcgccgcacaaccgcaggttgatgaagggctttcttacccgttgctgcaacagctgctggtgcaacatccgggcaaacgtctggtggtgaccggatttatcagccgcaacaacgccggtgaaacggtgctgctggggcgtaacggttccgactattccgcgacacaaatcggtgcgctggcgggtgtttctcgcgtaaccatctggagcgacgtcgccggggtatacagtgccgacccgcgtaaagtgaaagatgcctgcctgctgccgttgctgcgtctggatgaggccagcgaactggcgcgcctggcggctcccgttcttcacgcccgtactttacagccggtttctggcagcgaaatcgacctgcaactgcgctgtagctacacgccggatcaaggttccacgcgcattgaacgcgtgctggcctccggtactggtgcgcgtattgtcaccagccacgatgatgtctgtttgattgagtttcaggtgcccgccagtcaggatttcaaactggcgcataaagagatcgaccaaatcctgaaacgcgcgcaggtacgcccgctggcggttggcgtacataacgatcgccagttgctgcaattttgctacacctcagaagtggccgacagtgcgctgaaaatcctcgacgaagcgggattacctggcgaactgcgcctgcgtcaggggctggcgctggtggcgatggtcggtgcaggcgtcacccgtaacccgctgcattgccaccgcttctggcagcaactgaaaggccagccggtcgaatttacctggcagtccgatgacggcatcagcctggtggcagtactgcgcaccggcccgaccgaaagcctgattcaggggctgcatcagtccgtcttccgcgcagaaaaacgcatcggcctggtattgttcggtaagggcaatatcggttcccgttggctggaactgttcgcccgtgagcagagcacgctttcggcacgtaccggctttgagtttgtgctggcaggtgtggtggacagccgccgcagcctgttgagctatgacgggctggacgccagccgcgcgttagccttcttcaacgatgaagcggttgagcaggatgaagagtcgttgttcctgtggatgcgcgcccatccgtatgatgatttagtggtgctggacgttaccgccagccagcagcttgctgatcagtatcttgatttcgccagccacggtttccacgttatcagcgccaacaaactggcgggagccagcgacagcaataaatatcgccagatccacgacgccttcgaaaaaaccgggcgtcactggctgtacaatgccaccgtcggtgcgggcttgccgatcaaccacaccgtgcgcgatctgatcgacagcggcgatactattttgtcgatcagcgggatcttctccggcacgctctcctggctgttcctgcaattcgacggtagcgtgccgtttaccgagctggtggatcaggcgtggcagcagggcttaaccgaacctgacccgcgtgacgatctctctggcaaagacgtgatgcgcaagctggtgattctggcgcgtgaagcaggttacaacatcgaaccggatcaggtacgtgtggaatcgctggtgcctgctcattgcgaaggcggcagcatcgaccatttctttgaaaatggcgatgaactgaacgagcagatggtgcaacggctggaagcggcccgcgaaatggggctggtgctgcgctacgtggcgcgtttcgatgccaacggtaaagcgcgtgtaggcgtggaagcggtgcgtgaagatcatccgttggcatcactgctgccgtgcgataacgtctttgccatcgaaagccgctggtatcgcgataaccctctggtgatccgcggacctggcgctgggcgcgacgtcaccgccggggcgattcagtcggatatcaaccggctggcacagttgttgtaa

SEQ ID NO: 47330 - DNA, 2181 bp, Escherichia coli
atgagcacgtcagacgatatccataacaccacagccactggcaaatgcccgttccatcagggcggtcacgaccagagtgcgggggcgggcacaaccactcgcgactggtggccaaatcaacttcgtgttgacctgttaaaccaacattctaatcgttctaacccactgggtgaggactttgactaccgcaaagaattcagcaaattagattactacggcctgaaaaaagatctgaaagccctgttgacagaatctcaaccgtggtggccagccgactggggcagttacgccggtctgtttattcgtatggcctggcacggcgcggggacttaccgttcaatcgatggacgcggtggcgcgggtcgtggtcagcaacgttttgcaccgctgaactcctggccggataacgtaagcctcgataaagcgcgtcgcctgttgtggccaatcaaacagaaatatggtcagaaaatctcctgggccgacctgtttatcctcgcgggtaacgtggcgctagaaaactccggcttccgtaccttcggttttggtgccggtcgtgaagacgtctgggaaccggatctggatgttaactggggtgatgaaaaagcctggctgactcaccgtcatccggaagcgctggcgaaagcaccgctgggtgcaaccgagatgggtctgatttacgttaacccggaaggcccggatcacagcggcgaaccgctttctgcggcagcagctatccgcgcgaccttcggcaacatgggcatgaacgacgaagaaaccgtggcgctgattgcgggtggtcatacgctgggtaaaacccacggtgccggtccgacatcaaatgtaggtcctgatccagaagctgcaccgattgaagaacaaggtttaggttgggcgagcacttacggcagcggcgttggcgcagatgccattacctctggtctggaagtagtctggacccagacgccgacccagtggagcaactatttcttcgagaacctgttcaagtatgagtgggtacagacccgcagcccggctggcgcaatccagttcgaagcggtagacgcaccggaaattatcccggatccgtttgatccgtcgaagaaacgtaaaccgacaatgctggtgaccgacctgacgctgcgttttgatcctgagttcgagaagatctctcgtcgtttcctcaacgatccgcaggcgttcaacgaagcctttgcccgtgcctggttcaaactgacgcacagggatatggggccgaaatctcgctacatcgggccggaagtgccgaaagaagatctgatctggcaagatccgctgccgcagccgatctacaacccgaccgagcaggacattatcgatctgaaattcgcgattgcggattctggtctgtctgttagtgagctggtatcggtggcctgggcatctgcttctaccttccgtggtggcgacaaacgcggtggtgccaacggtgcgcgtctggcattaatgccgcagcgcgactgggatgtgaacgccgcagccgttcgtgctctgcctgttctggagaaaatccagaaagagtctggtaaagcctcgctggcggatatcatagtgctggctggtgtggttggtgttgagaaagccgcaagcgccgcaggtttgagcattcatgtaccgtttgcgccgggtcgcgttgatgcgcgtcaggatcagactgacattgagatgtttgagctgctggagccaattgctgacggtttccgtaactatcgcgctcgtctggacgtttccaccaccgagtcactgctgatcgacaaagcacagcaactgacgctgaccgcgccggaaatgactgcgctggtgggcggcatgcgtgtactgggtgccaacttcgatggcagcaaaaacggcgtcttcactgaccgcgttggcgtattgagcaatgacttcttcgtgaacttgctggatatgcgttacgagtggaaagcgaccgacgaatcgaaagagctgttcgaaggccgtgaccgtgaaaccggcgaagtgaaatttacggccagccgtgcggatctggtgtttggttctaactccgtcctgcgtgcggtggcggaagtttacgccagtagcgatgcccacgagaagtttgttaaagacttcgtggcggcatgggtgaaagtgatgaacctcgaccgtttcgacctgctgtaa

SEQ ID NO: 47331 - DNA, 1143 bp, Escherichia coli
atgccgcatttggcactactcatctctaaaggagcaattatggaccgcattattcaatcaccgggtaaatacatccagggcgctgatgtgattaatcgtctgggcgaatacctgaagccgctggcagaacgctggttagtggtgggtgacaaatttgttttaggttttgctcaatccactgtcgagaaaagctttaaagatgctggactggtagtagaaattgcgccgtttggcggtgaatgttcgcaaaatgagatcgaccgtctgcgtggcatcgcggagactgcgcagtgtggcgcaattctcggtatcggtggcggaaaaaccctcgatactgccaaagcactggcacatttcatgggtgttccggtagcgatcgcaccgactatcgcctctaccgatgcaccgtgcagcgcattgtctgttatctacaccgatgagggtgagtttgaccgctatctgctgttgccaaataacccgaatatggtcattgtcgacaccaaaatcgtcgctggcgcacctgcacgtctgttagcggcgggtatcggcgatgcgctggcaacctggtttgaagcgcgtgcctgctctcgtagcggcgcgaccaccatggcgggcggcaagtgcacccaggctgcgctggcactggctgaactgtgctacaacaccctgctggaagaaggcgaaaaagcgatgcttgctgccgaacagcatgtagtgactccggcgctggagcgcgtgattgaagcgaacacctatttgagcggtgttggttttgaaagtggtggtctggctgcggcgcacgcagtgcataacggcctgaccgctatcccggacgcgcatcactattatcacggtgaaaaagtggcattcggtacgctgacgcagctggttctggaaaatgcgccggtggaggaaatcgaaaccgtagctgcccttagccatgcggtaggtttgccaataactctcgctcaactggatattaaagaagatgtcccggcgaaaatgcgaattgtggcagaagcggcatgtgcagaaggtgaaaccattcacaacatgcctggcggcgcgacgccagatcaggtttacgccgctctgctggtagccgaccagtacggtcagcgtttcctgcaagagtgggaataa

SEQ ID NO: 47332 - DNA, 2136 bp, Escherichia coli
gtgtgcagcggtagtgcaggcggcattctgacgccgatctcttctttagatctcaatgcgctgggtaatcttcccgcagccaaaggcgttgacgccgagcaatccgcactggaaaacggcctgacgctggtactgaaaaacattgagtttcgtctgctggatagcgacggtgctaccagcgcgattctggaagctcaccgatccctggctggcgatacttccctgcgcgaacatttactggcaggcgtcagcgccggattaagctgcgccgaagcaattgttgccagcgcgaatcacttttgcgaagagttttcccgttccagcagcagctacctgcaagaacgtgccctggacgtacgcgacgtctgcttccagttactccagcaaatctacggtgagcaacgcttcccggcaccgggcaaactgacgcagcccgccatttgtatggctgatgaactgacccccagccagttcctcgaactggataaaaatcacctcaaaggattgttgctcaaaagcggcggcaccacctcacatacggtgatccttgcccgttcgttcaacattccaacgctggttggtgtggatattgatgcccttactccgtggcagcaacaaacgatttatatcgacggcaacgccggggcgattgtggttgagccaggggaagccgtagctcgttattatcagcaagaagcccgcgtacaggacgccctgcgtgagcaacagcgtgtctggctgacccaacaagcccgtaccgctgacggtatccgcattgaaattgccgctaacatcgctcactccgtggaagcgcaggccgcattcggcaatggtgcggaaggcgttggtttgttccgcactgaaatgctctatatggatcgcaccagcgcaccgggcgaaagcgagttgtacaacattttttgtcaggcgctggaatccgccaacggacgcagcattattgtgcgcactatggacattggcggcgacaaacccgttgattatctgaacattcccgcagaggcaaacccgttcctcggttatcgcgccgtgcgtatttatgaagagtacgcgtcgttgtttaccacgcagctacggtcgatcctccgcgcctccgctcacggcagcctgaaaatcatgatcccgatgatctcctcaatggaagagatcttatgggtgaaagaaaaactggcggaagccaaacagcaactacgtaacgaacacattccgtttgatgagaaaatccagctcggcatcatgctggaagtgccgtcggtgatgttcatcatcgatcaatgctgcgaagagattgatttctttagtattggtagtaatgacctgacgcagtatctgctggcggtggatcgcgataacgctaaggttactcgtcactacaacagcctgaatccggcattcttgcgggcgctcgattacgccgtgcaagcggtgcatcgccagggcaaatggattggtctgtgcggtgagctgggagcgaaaggttccgtgctgccgttgctggtcggcttagggctggatgaactcagcatgagcgcaccatcaattccggcggcgaaagctcggatggcgcaacttgatagccgtgagtgccgcaagttgctcaaccaggcaatggcctgccgtacttcgctggaagtagaacacctgctggcgcaattccgcatgacccaacaagacgcaccgctggtcaccgccgagtgcatcacactggaaagcgactggcgcagcaaagaagaagtgctcaaaggcatgaccgataacctgctgctggcgggccgctgccgctatccgcgtaaactggaagccgacttgtgggcgcgcgaggccgttttctctaccggtctgggctttagttttgccattccacacagcaaatcagaacacattgagcaatccaccatcagcgtggcgcgtctgcaagcgccggtgcgctggggcgatgatgaagcgcaattcatcattatgttaaccctgaacaaacacgctgcgggcgatcagcatatgcgcattttctcgcgcctcgctcgccgcatcatgcacgaagaattccgtaacgcgctggttaacgccgcctctgccgacgctatcgccagcctgctgcaacatgaactggaactgtaa

SEQ ID NO: 47333 - DNA, 2652 bp, Escherichia coli
atgaacgaacaatattccgcattgcgtagtaatgtcagtatgctcggcaaagtgctgggagaaaccatcaaggatgcgttgggagaacacattcttgaacgcgtagaaactatccgtaagttgtcgaaatcttcacgcgctggcaatgatgctaaccgccaggagttgctcaccaccttacaaaatttgtcgaacgacgagctgctgcccgttgcgcgtgcgtttagtcagttcctgaacctggccaacaccgccgagcaataccacagcatttcgccgaaaggcgaagctgccagcaacccggaagtgatcgcccgcaccctgcgtaaactgaaaaaccagccggaactgagcgaagacaccatcaaaaaagcagtggaatcgctgtcgctggaactggtcctcacggctcacccaaccgaaattacccgtcgtacactgatccacaaaatggtggaagtgaacgcctgtttaaaacagctcgataacaaagatatcgctgactacgaacacaaccagctgatgcgtcgcctgcgccagttgatcgcccagtcatggcataccgatgaaatccgtaagctgcgtccaagcccggtagatgaagccaaatggggctttgccgtagtggaaaacagcctgtggcaaggcgtaccaaattacctgcgcgaactgaacgaacaactggaagagaacctcggctacaaactgcccgtcgaatttgttccggtccgttttacttcgtggatgggcggcgaccgcgacggcaacccgaacgtcactgccgatatcacccgccacgtcctgctactcagccgctggaaagccaccgatttgttcctgaaagatattcaggtgctggtttctgaactgtcgatggttgaagcgacccctgaactgctggcgctggttggcgaagaaggtgccgcagaaccgtatcgctatctgatgaaaaacctgcgttctcgcctgatggcgacacaggcatggctggaagcgcgcctgaaaggcgaagaactgccaaaaccagaaggcctgctgacacaaaacgaagaactgtgggaaccgctctacgcttgctaccagtcacttcaggcgtgtggcatgggtattatcgccaacggcgatctgctcgacaccctgcgccgcgtgaaatgtttcggcgtaccgctggtccgtattgatatccgtcaggagagcacgcgtcataccgaagcgctgggcgagctgacccgctacctcggtatcggcgactacgaaagctggtcagaggccgacaaacaggcgttcctgatccgcgaactgaactccaaacgtccgcttctgccgcgcaactggcaaccaagcgccgaaacgcgcgaagtgctcgatacctgccaggtgattgccgaagcaccgcaaggctccattgccgcctacgtgatctcgatggcgaaaacgccgtccgacgtactggctgtccacctgctgctgaaagaagcgggtatcgggtttgcgatgccggttgctccgctgtttgaaaccctcgatgatctgaacaacgccaacgatgtcatgacccagctgctcaatattgactggtatcgtggcctgattcagggcaaacagatggtgatgattggctattccgactcagcaaaagatgcgggagtgatggcagcttcctgggcgcaatatcaggcacaggatgcattaatcaaaacctgcgaaaaagcgggtattgagctgacgttgttccacggtcgcggcggttccattggtcgcggcggcgcacctgctcatgcggcgctgctgtcacaaccgccaggaagcctgaaaggcggcctgcgcgtaaccgaacagggcgagatgatccgctttaaatatggtctgccagaaatcaccgtcagcagcctgtcgctttataccggggcgattctggaagccaacctgctgccaccgccggagccgaaagagagctggcgtcgcattatggatgaactgtcagtcatctcctgcgatgtctaccgcggctacgtacgtgaaaacaaagattttgtgccttacttccgctccgctacgccggaacaagaactgggcaaactgccgttgggttcacgtccggcgaaacgtcgcccaaccggcggcgtcgagtcactacgcgccattccgtggatcttcgcctggacgcaaaaccgtctgatgctccccgcctggctgggtgcaggtacggcgctgcaaaaagtggtcgaagacggcaaacagagcgagctggaggctatgtgccgcgattggccattcttctcgacgcgtctcggcatgctggagatggtcttcgccaaagcagacctgtggctggcggaatactatgaccaacgcctggtagacaaagcactgtggccgttaggtaaagagttacgcaacctgcaagaagaagacatcaaagtggtgctggcgattgccaacgattcccatctgatggccgatctgccgtggattgcagagtctattcagctacggaatatttacaccgacccgctgaacgtattgcaggccgagttgctgcaccgctcccgccaggcagaaaaagaaggccaggaaccggatcctcgcgtcgaacaagcgttaatggtcactattgccgggattgcggcaggtatgcgtaataccggctaa

SEQ ID NO: 47334 - DNA, 1005 bp, Escherichia coli
atgttgaatacgctgattgtgggtgccagcggctacgctggcgcagagctagtgacctatgtaaatcgccatccgcatatgaacataaccgctttgactgtttcagcgcaaagcaatgatgcgggaaagttaatctccgatttgcatccgcagctaaaaggcatcgttgatctgccgttgcagccgatgtcggatatcagcgagtttagcccaggggtggacgtagtgtttctcgccaccgcccatgaagttagccacgatttagcgccgcagtttcttgaagcgggctgcgtggtgttcgacctttccggcgcgtttcgtgttaacgacgccaccttctatgaaaaatattacggctttacccatcaatacccggaactgttggaacaggcagcctacggtctggcggagtggtgcggtaataaattaaaagaagcgaatttgattgcggtgccgggctgttatccgacggcggcacagctggcgctgaaaccgttgattgatgccgatcttcttgacctcaatcagtggccggtgatcaacgccaccagcggcgtgagcggtgcagggcgtaaagcggccatttcaaacagcttttgtgaagttagcctgcaaccgtatggcgtctttactcatcgccatcaaccagagatcgccacacacctcggtgctgacgttatcttcaccccacatctgggcaatttcccgcgcggcattctcgaaaccattacctgccgcctgaaatcgggtgtgacccaggcgcaagtcgcgcaagtgttacagcaggcgtatgcccataaaccgctggtgcggctgtatgacaaaggcgttccggcgctgaaaaatgtcgttgggctgccattttgcgatatcgggtttgccgttcagggcgagcatctgattattgtggcgaccgaagacaacttactgaaaggcgcggcggcacaagcggtacagtgcgccaatattcgtttcggctatgcggaaacgcagtctcttatttaa

SEQ ID NO: 47335 - DNA, 777 bp, Escherichia coli
atgatgaatccattaattatcaaactgggcggcgtactgctggatagtgaagaggcgctggaacgtctgtttagcgcactggtgaattatcgtgagtcacatcagcgtccgctggtgattgtgcacggcggcggttgcgtggtggatgagctgatgaaagggctgaatctgccggtgaaaaagaaaaacggcctgcgggtgacgcctgctgatcagatagacattatcaccggagcactggcgggaacggcaaataaaaccctgttggcatgggcgaagaaacatcagattgcggccgtaggtttgtttctcggtgacggcgacagcgtcaaagtgacccagcttgatgaagagttaggtcatgttggactggcgcagccaggttcgcctaagcttatcaactccttgctggagaacggttatctgccggtggtcagctccattggcgtaacagacgaagggcaactgatgaacgtcaatgccgaccaggcggcaacggcgctggcggcaacgctgggcgcggatctgattttgctctccgacgtcagcggcattctcgacggcaaagggcaacgcattgccgaaatgaccgccgcgaaagcagaacaactgattgagcagggcattattactgacggcatgatagtgaaagtgaacgcggcgctggatgcggcccgcacgctgggccgtccggtagatatcgcctcctggcgtcatgcggagcagcttccggcactgtttaacggtatgccgatgggtacgcggattttagcttaa

SEQ ID NO: 47336 - DNA, 1374 bp, Escherichia coli
atggcactttggggcgggcgttttacccaggcagcagatcaacggttcaaacaattcaacgactcactgcgctttgattaccgtctggcggagcaggatattgttggctctgtggcctggtccaaagccctggtcacggtaggcgtgttaaccgcagaagagcaggcgcaactggaagaggcgctgaacgtgttgctggaagatgttcgcgccaggccacaacaaatccttgaaagcgacgccgaagatatccatagctgggtggaaggcaaactgatcgacaaagtgggccagttaggcaaaaagctgcataccgggcgtagccgtaatgatcaggtagcgactgacctgaaactgtggtgcaaagataccgttagcgagttactgacggctaaccggcagctgcaatcggcgctggtggaaaccgcacaaaacaatcaggacgcggtaatgccaggttacactcacctgcaacgcgcccagccggtgacgttcgcgcactggtgcctggcctatgttgagatgctggcgcgtgatgaaagccgtttgcaggatgcgcttaagcgtctggatgtcagcccgctaggctgtggcgcgctggcgggaacggcctatgaaatcgaccgtgaacagttagcaggctggctgggctttgcttcggcgacccgtaacagtctcgacagcgtttctgaccgtgaccatgtgttggaactgctttctgctgccgctatcggcatggtgcatctgtcgcgttttgctgaagatctgattttctttaacaccggcgaagcggggtttgtggagctttctgaccgcgtgacttccggttcatcattaatgccgcagaagaaaaacccggatgcgctggagctgattcgcggtaaatgcggccgggtgcagggggcgttaaccggcatgatgatgacgctgaaaggtttgccgctggcttacaacaaagatatgcaggaagacaaagaaggtctgttcgacgcgctcgatacctggctggactgcctgcatatggcggcgctggtgctggacggcattcaggtgaaacgtccacgttgccaggaagcggctcagcagggttacgccaacgccaccgaactggcggattatctggtggcgaaaggcgtaccgttccgcgaggcgcaccatattgttggtgaagcggtggtggaagccattcgtcagggcaaaccgctggaagatctgccgctcagtgagttgcagaaattcagtcaggtgattgacgaagatgtctatccgattctgtcgctgcaatcgtgcctcgacaagcgtgcggcaaaaggcggcgtctcaccgcagcaggtggcgcaggcgattgcttttgcgcaggctcggttagggtaa

SEQ ID NO: 47337 - DNA, 1335 bp, Escherichia coli
atgggcctggttaagcaaggtgcgcgcgtcgcagttatcgagcgttatcaaaatgttggcggcggttgcacccactggggcaccatcccgtcgaaagctctccgtcacgccgtcagccgcattatagaattcaatcaaaacccactttacagcgaccattcccgactgctccgctcttcttttgccgatatccttaaccatgccgataacgtgattaatcaacaaacgcgcatgcgtcagggattttacgaacgtaatcactgtgaaatattgcagggaaacgctcgctttgttgacgagcatacgttggcgctggattgcccggacggcagcgttgaaacactaaccgctgaaaaatttgttattgcctgcggctctcgtccatatcatccaacagatgttgatttcacccatccacgcatttacgacagcgactcaattctcagcatgcaccacgaaccgcgccatgtacttatctatggtgctggagtgatcggctgtgaatatgcgtcgatcttccgcggtatggatgtaaaagtggatctgatcaacacccgcgatcgcctgctggcatttctcgatcaagagatgtcagattctctctcctatcacttctggaacagtggcgtagtgattcgtcacaacgaagagtacgagaagatcgaaggctgtgacgatggtgtgatcatgcatctgaagtcgggtaaaaaactgaaagctgactgcctgctctatgccaacggtcgcaccggtaataccgattcgctggcgttacagaacattgggctagaaactgacagccgcggacagctgaaggtcaacagcatgtatcagaccgcacagccacacgtttacgcggtgggcgacgtgattggttatccgagcctggcgtcggcggcctatgaccaggggcgcattgccgcgcaggcgctggtaaaaggcgaagccaccgcacatctgattgaagatatccctaccggtatttacaccatcccggaaatcagctctgtgggcaaaaccgaacagcagctgaccgcaatgaaagtgccatatgaagtgggccgcgcccagtttaaacatctggcacgcgcacaaatcgtcggcatgaacgtgggcacgctgaaaattttgttccatcgggaaacaaaagagattctgggtattcactgctttggcgagcgcgctgccgaaattattcatatcggtcaggcgattatggaacagaaaggtggcggcaacactattgagtacttcgtcaacaccacctttaactacccgacgatggcggaagcctatcgggtagctgcgttaaacggtttaaaccgcctgttttaa

SEQ ID NO: 47338 - DNA, 4029 bp, Escherichia coli
atggtttactcctataccgagaaaaaacgtattcgtaaggattttggtaaacgtccacaagttctggatgtaccttatctcctttctatccagcttgactcgtttcagaaatttatcgagcaagatcctgaagggcagtatggtctggaagctgctttccgttccgtattcccgattcagagctacagcggtaattccgagctgcaatacgtcagctaccgccttggcgaaccggtgtttgacgtccaggaatgtcaaatccgtggcgtgacctattccgcaccgctgcgcgttaaactgcgtctggtgatctatgagcgcgaagcgccggaaggcaccgtaaaagacattaaagaacaagaagtctacatgggcgaaattccgctcatgacagacaacggtacctttgttatcaacggtactgagcgtgttatcgtttcccagctgcaccgtagtccgggcgtcttctttgactccgacaaaggtaaaacccactcttcgggtaaagtgctgtataacgcgcgtatcatcccttaccgtggttcctggctggacttcgaattcgatccgaaggacaacctgttcgtacgtatcgaccgtcgccgtaaactgcctgcgaccatcattctgcgcgccctgaactacaccacagagcagatcctcgacctgttctttgaaaaagttatctttgaaatccgtgataacaagctgcagatggaactggtgccggaacgcctgcgtggtgaaaccgcatcttttgacatcgaagctaacggtaaagtgtacgtagaaaaaggccgccgtatcactgcgcgccacattcgccagctggaaaaagacgacgtcaaactgatcgaagtcccggttgagtacatcgcaggtaaagtggttgctaaagactatattgatgagtctaccggcgagctgatctgcgcagcgaacatggagctgagcctggatctgctggctaagctgagccagtctggtcacaagcgtatcgaaacgctgttcaccaacgatctggatcacggcccatatatctctgaaaccttacgtgtcgacccaactaacgaccgtctgagcgcactggtagaaatctaccgcatgatgcgccctggcgagccgccgactcgtgaagcagctgaaagcctgttcgagaacctgttcttctccgaagaccgttatgacttgtctgcggttggtcgtatgaagttcaaccgttctctgctgcgcgaagaaatcgaaggttccggtatcctgagcaaagacgacatcattgatgttatgaaaaagctcatcgatatccgtaacggtaaaggcgaagtcgatgatatcgaccacctcggcaaccgtcgtatccgttccgttggcgaaatggcggaaaaccagttccgcgttggcctggtacgtgtagagcgtgcggtgaaagagcgtctgtctctgggcgatctggataccctgatgccacaggatatgatcaacgccaagccgatttccgcagcagtgaaagagttcttcggttccagccagctgtctcagtttatggaccagaacaacccgctgtctgagattacgcacaaacgtcgtatctccgcactcggcccaggcggtctgacccgtgaacgtgcaggcttcgaagttcgagacgtacacccgactcactacggtcgcgtatgtccaatcgaaacccctgaaggtccgaacatcggtctgatcaactctctgtccgtgtacgcacagactaacgaatacggcttccttgagactccgtatcgtaaagtgaccgacggtgttgtaactgacgaaattcactacctgtctgctatcgaagaaggcaactacgttatcgcccaggcgaactccaacttggatgaagaaggccacttcgtagaagacctggtaacttgccgtagcaaaggcgaatccagcttgttcagccgcgaccaggttgactacatggacgtatccacccagcaggtggtatccgtcggtgcgtccctgatcccgttcctggaacacgatgacgccaaccgtgcattgatgggtgcgaacatgcaacgtcaggccgttccgactctgcgcgctgataagccgctggttggtactggtatggaacgtgctgttgccgttgactccggtgtaactgcggtagctaaacgtggtggtgtcgttcagtacgtggatgcttcccgtatcgttatcaaagttaacgaagacgagatgtatccgggtgaagcaggtatcgacatctacaacctgaccaaatacacccgttctaaccagaacacctgtatcaaccagatgccgtgtgtgtctctgggtgaaccggttgaacgtggcgacgtgctggcagacggtccgtccaccgacctcggtgaactggcgcttggtcagaacatgcgcgtagcgttcatgccgtggaatggttacaacttcgaagactccatcctcgtatccgagcgtgttgttcaggaagaccgtttcaccaccatccacattcaggaactggcgtgtgtgtcccgtgacaccaagctgggtccggaagagatcaccgctgacatcccgaacgtgggtgaagctgcgctctccaaactggatgaatccggtatcgtttacattggtgcggaagtgaccggtggcgacattctggttggtaaggtaacgccgaaaggtgaaactcagctgaccccagaagaaaaactgctgcgtgcgatcttcggtgagaaagcctctgacgttaaagactcttctctgcgcgtaccaaacggtgtatccggtacggttatcgacgttcaggtctttactcgcgatggcgtagaaaaagacaaacgtgcgctggaaatcgaagaaatgcagctcaaacaggcgaagaaagacctgtctgaagaactgcagatcctcgaagcgggtctgttcagccgtatccgtgctgtgctggtagccggtggcgttgaagctgagaagctcgacaaactgccgcgcgatcgctggctggagctgggcctgacagacgaagagaaacaaaatcagctggaacagctggctgagcagtatgacgaactgaaacacgagttcgagaagaaactcgaagcgaaacgccgcaaaatcacccagggcgacgatctggcaccgggcgtgctgaagattgttaaggtatatctggcggttaaacgccgtatccagcctggtgacaagatggcaggtcgtcacggtaacaagggtgtaatttctaagatcaacccgatcgaagatatgccttacgatgaaaacggtacgccggtagacatcgtactgaacccgctgggcgtaccgtctcgtatgaacatcggtcagatcctcgaaacccacctgggtatggctgcgaaaggtatcggcgacaagatcaacgccatgctgaaacagcagcaagaagtcgcgaaactgcgcgaattcatccagcgtgcgtacgatctgggcgctgacgttcgtcagaaagttgacctgagtaccttcagcgatgaagaagttatgcgtctggctgaaaacctgcgcaaaggtatgccaatcgcaacgccggtgttcgacggtgcgaaagaagcagaaattaaagagctgctgaaacttggcgacctgccgacttccggtcagatccgcctgtacgatggtcgcactggtgaacagttcgagcgtccggtaaccgttggttacatgtacatgctgaaactgaaccacctggtcgacgacaagatgcacgcgcgttccaccggttcttacagcctggttactcagcagccgctgggtggtaaggcacagttcggtggtcagcgtttcggggagatggaagtgtgggcgctggaagcatacggcgcagcatacaccctgcaggaaatgctcaccgttaagtctgatgacgtgaacggtcgtaccaagatgtataaaaacatcgtggacggcaaccatcagatggagccgggcatgccagaatccttcaacgtattgttgaaagagattcgttcgctgggtatcaacatcgaactggaagacgagtaa

SEQ ID NO: 47339 - DNA, 4224 bp, Escherichia coli
gtgaaagatttattaaagtttctgaaagcgcagactaaaaccgaagagtttgatgcgatcaaaattgctctggcttcgccagacatgatccgttcatggtctttcggtgaagttaaaaagccggaaaccatcaactaccgtacgttcaaaccagaacgtgacggccttttctgcgcccgtatctttgggccggtaaaagattacgagtgcctgtgcggtaagtacaagcgcctgaaacaccgtggcgtcatctgtgagaagtgcggcgttgaagtgacccagactaaagtacgccgtgagcgtatgggccacatcgaactggcttccccgactgcgcacatctggttcctgaaatcgctgccgtcccgtatcggtctgctgctcgatatgccgctgcgcgatatcgaacgcgtactgtactttgaatcctatgtggttatcgaaggcggtatgaccaacctggaacgtcagcagatcctgactgaagagcagtatctggacgcgctggaagagttcggtgacgaattcgacgcgaagatgggggcggaagcaatccaggctctgctgaagagcatggatctggagcaagagtgcgaacagctgcgtgaagagctgaacgaaaccaactccgaaaccaagcgtaaaaagctgaccaagcgtatcaaactgctggaagcgttcgttcagtctggtaacaaaccagagtggatgatcctgaccgttctgccggtactgccgccagatctgcgtccgctggttccgctggatggtggtcgtttcgcgacttctgacctgaacgatctgtatcgtcgcgtcattaaccgtaacaaccgtctgaaacgtctgctggatctggctgcgccggacatcatcgtacgtaacgaaaaacgtatgctgcaggaagcggtagacgccctgctggataacggtcgtcgcggtcgtgcgatcaccggttctaacaagcgtcctctgaaatctttggccgacatgatcaaaggtaaacagggtcgtttccgtcagaacctgctcggtaagcgtgttgactactccggtcgttctgtaatcaccgtaggtccatacctgcgtctgcatcagtgcggtctgccgaagaaaatggcactggagctgttcaaaccgttcatctacggcaagctggaactgcgtggtcttgctaccaccattaaagctgcgaagaaaatggttgagcgcgaagaagctgtcgtttgggatatcctggacgaagttatccgcgaacacccggtactgctgaaccgtgcaccgactctgcaccgtctgggtatccaggcatttgaaccggtactgatcgaaggtaaagctatccagctgcacccgctggtttgtgcggcatataacgccgacttcgatggtgaccagatggctgttcacgtaccgctgacgctggaagcccagctggaagcgcgtgcgctgatgatgtctaccaacaacatcctgtccccggcgaacggcgaaccaatcatcgttccgtctcaggacgttgtactgggtctgtactacatgacccgtgactgtgttaacgccaaaggcgaaggcatggtgctgactggcccgaaagaagcagaacgtctgtatcgctctggtctggcttctctgcatgcgcgcgttaaagtgcgtatcaccgagtatgaaaaagatgctaacggtgaattagtagcgaaaaccagcctgaaagacacgactgttggccgtgccattctgtggatgattgtaccgaaaggtctgccttactccatcgtcaaccaggcgctgggtaaaaaagcaatctccaaaatgctgaacacctgctaccgcattctcggtctgaaaccgaccgttatttttgcggaccagatcatgtacaccggcttcgcctatgcagcgcgttctggtgcatctgttggtatcgatgacatggtcatcccggagaagaaacacgaaatcatctccgaggcagaagcagaagttgctgaaattcaggagcagttccagtctggtctggtaactgcgggcgaacgctacaacaaagttatcgatatctgggctgcggcgaacgatcgtgtatccaaagcgatgatggataacctgcaaactgaaaccgtgattaaccgtgacggtcaggaagagaagcaggtttccttcaacagcatctacatgatggccgactccggtgcgcgtggttctgcggcacagattcgtcagcttgctggtatgcgtggtctgatggcgaagccggatggctccatcatcgaaacgccaatcaccgcgaacttccgtgaaggtctgaacgtactccagtacttcatctccacccacggtgctcgtaaaggtctggcggataccgcactgaaaactgcgaactccggttacctgactcgtcgtctggttgacgtggcgcaggacctggtggttaccgaagacgattgtggtacccatgaaggtatcatgatgactccggttatcgagggtggtgacgttaaagagccgctgcgcgatcgcgtactgggtcgtgtaactgctgaagacgttctgaagccgggtactgctgatatcctcgttccgcgcaacacgctgctgcacgaacagtggtgtgacctgctggaagagaactctgtcgacgcggttaaagtacgttctgttgtatcttgtgacaccgactttggtgtatgtgcgcactgctacggtcgtgacctggcgcgtggccacatcatcaacaagggtgaagcaatcggtgttatcgcggcacagtccatcggtgaaccgggtacacagctgaccatgcgtacgttccacatcggtggtgcggcatctcgtgcggctgctgaatccagcatccaagtgaaaaacaaaggtagcatcaagctcagcaacgtgaagtcggttgtgaactccagcggtaaactggttatcacttcccgtaatactgaactgaaactgatcgacgaattcggtcgtactaaagaaagctacaaagtaccttacggtgcggtactggcgaaaggcgatggcgaacaggttgctggcggcgaaaccgttgcaaactgggacccgcacaccatgccggttatcaccgaagtaagcggttttgtacgctttactgacatgatcgacggccagaccattacgcgtcagaccgacgaactgaccggtctgtcttcgctggtggttctggattccgcagaacgtaccgcaggtggtaaagatctgcgtccggcactgaaaatcgttgatgctcagggtaacgacgttctgatcccaggtaccgatatgccagcgcagtacttcctgccgggtaaagcgattgttcagctggaagatggcgtacagatcagctctggtgacaccctggcgcgtattccgcaggaatccggcggtaccaaggacatcaccggtggtctgccgcgcgttgcggacctgttcgaagcacgtcgtccgaaagagccggcaatcctggctgaaatcagcggtatcgtttccttcggtaaagaaaccaaaggtaaacgtcgtctggttatcaccccggtagacggtagcgatccgtacgaagagatgattccgaaatggcgtcagctcaacgtgttcgaaggtgaacgtgtagaacgtggtgacgtaatttccgacggtccggaagcgccgcacgacattctgcgtctgcgtggtgttcatgctgttactcgttacatcgttaacgaagtacaggacgtataccgtctgcagggcgttaagattaacgataaacacatcgaagttatcgttcgtcagatgctgcgtaaagctaccatcgttaacgcgggtagctccgacttcctggaaggcgaacaggttgaatactctcgcgtcaagatcgcaaaccgcgaactggaagcgaacggcaaagtgggtgcaacttactcccgcgatctgctgggtatcaccaaagcgtctctggcaaccgagtccttcatctccgcggcatcgttccaggagaccactcgcgtgctgaccgaagcagccgttgcgggcaaacgcgacgaactgcgcggcctgaaagagaacgttatcgtgggtcgtctgatcccggcaggtaccggttacgcgtaccaccaggatcgtatgcgtcgccgtgctgcgggtgaagctccggctgcaccgcaggtgactgcagaagacgcatctgccagcctggcagaactgctgaacgcaggtctgggcggttctgataacgagtaa

SEQ ID NO: 47340 - DNA, 1065 bp, Escherichia coli
atgaccgaacttaaaaacgatcgttatctgcgggcgctgctgcgccagcccgttgatgtcactccagtatggatgatgcgccaggcgggtcgctatctaccggaatataaagccacgcgcgcccaggcaggcgattttatgtcgctgtgcaaaaacgccgagctggcgtgcgaagtgactttgcaaccgctgcgtcgctacccgctggatgcggcgatcctcttttccgatatcctcaccgtgccggacgcgatggggttagggctctattttgaagccggagaaggtccgcgttttacctcgccagtcacctgcaaagctgacgtcgataaactgccaattccggacccggaagatgaactgggttacgtgatgaacgcggtgcgtaccattcgtcgcgaactgaaaggcgaagtgccgctgattggtttttccggcagcccgtggacgctggcgacctacatggtggaaggcggcagcagcaaagccttcaccgtgatcaaaaaaatgatgtatgccgatccgcaggcgctgcacgctctgctcgataaactggcgaaaagcgtcactttgtatctgaatgcgcagattaaagccggtgctcaggcagtgatgattttcgacacctggggcggcgtgcttaccgggcgcgattatcaacagttctcgctctattacatgcataaaattgttgatggtttactgcgtgaaaacgacggtcgccgcgtaccggtcacgctgtttaccaaaggcggcggacagtggctggaagccatggcagaaaccggttgcgatgcgctgggcctcgactggacaacggacatcgccgatgcgcgccgccgtgtgggcaataaagtcgcgttgcagggtaatatggatccgtcgatgctgtacgcgccgcctgcccgcattgaagaagaagtagcgactatacttgcaggtttcggtcacggcgaaggtcatgtctttaaccttggtcacggcattcatcaggatgtgccgccagaacatgctggcgtgttcgtggaggcagtgcatcgactgtctgaacagtatcaccgctaa

SEQ ID NO: 47341 - DNA, 1350 bp, Escherichia coli
atgtctgaaattgttgtctccaaatttggcggtaccagcgtagctgattttgacgccatgaaccgcagcgctgatattgtgctttctgatgccaacgtgcgtttagttgtcctctcggcttctgctggtatcactaatctgctggtcgctttagctgaaggactggaacctggcgagcgattcgaaaaactcgacgctatccgcaacatccagtttgccattctggaacgtctgcgttacccgaacgttatccgtgaagagattgaacgtctgctggagaacattactgttctggcagaagcggcggcgctggcaacgtctccggcgctgacagatgagctggtcagccacggcgagctgatgtcgaccctgctgtttgttgagatcctgcgcgaacgcgatgttcaggcacagtggtttgatgtacgtaaagtgatgcgtaccaacgaccgatttggtcgtgcagagccagatatagccgcgctggcggaactggccgcgctgcagctgctcccacgtctcaatgaaggcttagtgatcacccagggatttatcggtagcgaaaataaaggtcgtacaacgacgcttggccgtggaggcagcgattatacggcagccttgctggcggaggctttacacgcatctcgtgttgatatctggaccgacgtcccgggcatctacaccaccgatccacgcgtagtttccgcagcaaaacgcattgatgaaatcgcgtttgccgaagcggcagagatggcaacttttggtgcaaaagtactgcatccggcaacgttgctacccgcagtacgcagcgatatcccggtctttgtcggctccagcaaagacccacgcgcaggtggtacgctggtgtgcaataaaactgaaaatccgccgctgttccgcgctctggcgcttcgtcgcaatcagactctgctcactttgcacagcctgaatatgctgcattctcgcggtttcctcgcggaagttttcggcatcctcgcgcggcataatatttcggtagacttaatcaccacgtcagaagtgagcgtggcattaacccttgataccaccggttcaacctccactggcgatacgttgctgacgcaatctctgctgatggagctttccgcactgtgtcgggtggaggtggaagaaggtctggcgctggtcgcgttgattggcaatgacctgtcaaaagcctgcggcgttggcaaagaggtattcggcgtactggaaccgttcaacattcgcatgatttgttatggcgcatccagccataacctgtgcttcctggtgcccggcgaagatgccgagcaggtggtgcaaaaactgcatagtaatttgtttgagtaa

SEQ ID NO: 47342 - DNA, 1650 bp, Escherichia coli
atgaaaaacatcaatccaacgcagaccgctgcctggcaggcactacagaaacacttcgatgaaatgaaagacgttacgatcgccgatctttttgctaaagacggcgatcgtttttctaagttctccgcaaccttcgacgatcagatgctggtggattactccaaaaaccgcatcactgaagagacgctggcgaaattacaggatctggcgaaagagtgcgatctggcgggcgcgattaagtcgatgttctctggcgagaagatcaaccgcactgaaaaccgcgccgtgctgcacgtagcgctgcgtaaccgtagcaataccccgattttggttgatggcaaagacgtaatgccggaagtcaacgcggtgctggagaagatgaaaaccttctcagaagcgattatttccggtgagtggaaaggttataccggcaaagcaatcactgacgtagtgaacatcgggatcggcggttctgacctcggcccatacatggtgaccgaagctctgcgtccgtacaaaaaccacctgaacatgcactttgtttctaacgtcgatgggactcacatcgcggaagtgctgaaaaaagtaaacccggaaaccacgctgttcttggtagcatctaaaaccttcaccactcaggaaactatgaccaacgcccatagcgcgcgtgactggttcctgaaagcggcaggtgatgaaaaacacgttgcaaaacactttgcggcgctttccaccaatgccaaagccgttggcgagtttggtattgatactgccaacatgttcgagttctgggactgggttggcggccgttactctttgtggtcagcgattggcctgtcgattgttctctccatcggctttgataacttcgttgaactgctttccggcgcacacgcgatggacaagcatttctccaccacgcctgccgagaaaaacctgcctgtactgctggcgctgattggcatctggtacaacaatttctttggtgcggaaactgaagcgattctgccgtatgaccagtatatgcaccgtttcgcggcgtacttccagcagggcaatatggagtccaacggtaagtatgttgaccgtaacggtaacgttgtggattaccagactggcccgattatctggggtgaaccaggcactaacggtcagcacgcgttctaccagctgatccaccagggaaccaaaatggtaccgtgcgatttcatcgctccggctatcacccataacccgctctctgatcatcaccagaaactgctgtctaacttcttcgcccagaccgaagcgctggcgtttggtaaatcccgcgaagtggttgagcaggaatatcgtgatcagggtaaagatccggcaacgcttgactacgtggtgccgttcaaagtattcgaaggtaaccgcccgaccaactccatcctgctgcgtgaaatcactccgttcagcctgggtgcgttgattgcgctgtatgagcacaaaatctttactcagggcgtgatcctgaacatcttcaccttcgaccagtggggcgtggaactgggtaaacagctggcgaaccgtattctgccagagctgaaagatgataaagaaatcagcagccacgatagctcgaccaatggtctgattaaccgctataaagcgtggcgcggttaa

SEQ ID NO: 47343 - DNA, 1476 bp, Escherichia coli
atgaatacccagtataattccagttatatattttcgattaccttagtcgctacattaggtggtttattatttggctacgacaccgccgttatttccggtactgttgagtcactcaataccgtctttgttgctccacaaaacttaagtgaatccgctgccaactccctgttagggttttgcgtggccagcgctctgattggttgcatcatcggcggtgccctcggtggttattgcagtaaccgcttcggtcgtcgtgattcacttaagattgctgctgtcctgttttttatttctggtgtaggttctgcctggccagaacttggttttacctctataaacccggacaacactgtgcctgtttatctggcaggttatgtcccggaatttgttatttatcgcattattggcggtattggcgttggtttagcctcaatgctctcgccaatgtatattgcggaactggctccagctcatattcgcgggaaactggtctcttttaaccagtttgcgattattttcgggcaacttttagtttactgcgtaaactattttattgcccgttccggtgatgccagctggctgaatactgacggctggcgttatatgtttgcctcggaatgtatccctgcactgctgttcttaatgctgctgtataccgtgccagaaagtcctcgctggctgatgtcgcgcggcaagcaagaacaggcggaaggtatcctgcgcaaaattatgggcaacacgcttgcaactcaggcagtacaggaaattaaacactccctggatcatggccgcaaaaccggtggtcgtctgctgatgtttggcgtgggcgtgattgtaatcggcgtaatgctctccatcttccagcaatttgtcggcatcaatgtggtgctgtactacgcgccggaagtgttcaaaacgctgggggccagcacggatatcgcgctgttgcagaccattattgtcggagttatcaacctcaccttcaccgttctggcaattatgacggtggataaatttggtcgtaagccactgcaaattatcggcgcactcggaatggcaatcggtatgtttagcctcggtaccgcgttttacactcaggcaccgggtattgtggcgctactgtcgatgctgttctatgttgccgcctttgccatgtcctggggtccggtatgctgggtactgctgtcggaaatcttcccgaatgctattcgtggtaaagcgctggcaatcgcggtggcggcccagtggctggcgaactacttcgtctcctggaccttcccgatgatggacaaaaactcctggctggtggcccatttccacaacggtttctcctactggatttacggttgtatgggcgttctggcagcactgtttatgtggaaatttgtcccggaaaccaaaggtaaaacccttgaggagctggaagcgctctgggaaccggaaacgaagaaaacacaacaaactgctacgctgtaa

SEQ ID NO: 47344 - DNA, 1194 bp, Escherichia coli
gtgtttcaaaaagttgacgcctacgctggcgacccgattcttacgcttatggagcgttttaaagaagaccctcgcagcgacaaagtgaatttaagtatcggtctgtactacaacgaagacggaattattccacaactgcaagccgtggcggaggcggaagcgcgcctgaatgcgcagcctcatggcgcttcgctttatttaccgatggaagggcttaactgctatcgccatgccattgcgccgctgctgtttggtgcggaccatccggtactgaaacaacagcgcgtagcaaccattcaaacccttggcggctccggggcattgaaagtgggcgcggatttcctgaaacgctacttcccggaatcaggcgtctgggtcagcgatcctacctgggaaaaccacgtagcaatattcgccggggctggattcgaagtgagtacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgatcagtgggatgcggtgattgaaattctcaaagcccgcgagcttattccattcctcgatattgcctatcaaggatttggtgccggtatggaagaggatgcctacgctattcgcgccattgccagcgctggattacccgctctggtgagcaattcgttctcgaaaattttctccctttacggcgagcgcgtcggcggactttctgttatgtgtgaagatgccgaagccgctggccgcgtactggggcaattgaaagcaacagttcgccgcaactactccagcccgccgaattttggtgcgcaggtggtggctgcagtgctgaatgacgaggcattgaaagccagctggctggcggaagtagaagagatgcgtactcgcattctggcaatgcgtcaggaattggtgaaggtattaagcacagagatgccagaacgcaatttcgattatctgcttaatcagcgcggcatgttcagttataccggtttaagtgccgctcaggttgaccgactacgtgaagaatttggtgtctatctcatcgccagcggtcgcatgtgtgtcgccgggttaaatacggcaaatgtacaacgtgtggcaaaggcgtttgctgcggtgatgtaa

SEQ ID NO: 47345 - DNA, 1959 bp, Escherichia coli
atgagccaaattcacaaacacaccattcctgccaacatcgcagaccgttgcctgataaaccctcagcagtacgaggcgatgtatcaacaatctattaacgtacctgataccttctggggcgaacagggaaaaattcttgactggatcaaaccttaccagaaggtgaaaaacacctcctttgcccccggtaatgtgtccattaaatggtacgaggacggcacgctgaatctggcggcaaactgccttgaccgccatctgcaagaaaacggcgatcgtaccgccatcatctgggaaggcgacgacgccagccagagcaaacatatcagctataaagagctgcaccgcgacgtctgccgcttcgccaataccctgctcgagctgggcattaaaaaaggtgatgtggtggcgatttatatgccgatggtgccggaagccgcggttgcgatgctggcctgcgcccgcattggcgcggtgcattcggtgattttcggcggcttctcgccggaagccgttgccgggcgcattattgattccaactcacgactggtgatcacttccgacgaaggtgtgcgtgccgggcgcagtattccgctgaagaaaaacgttgatgacgcgctgaaaaacccgaacgtcaccagcgtagagcatgtggtggtactgaagcgtactggcgggaaaattgactggcaggaagggcgcgacctgtggtggcacgacctggttgagcaagcgagcgatcagcaccaggcggaagagatgaacgccgaagatccgctgtttattctctacacctccggttctaccggtaagccaaaaggtgtgctgcatactaccggcggttatctggtgtacgcggcgctgacctttaaatatgtctttgattatcatccgggtgatatctactggtgcaccgccgatgtgggctgggtgaccggacacagttacttgctgtacggcccgctggcctgcggtgcgaccacgctgatgtttgaaggcgtacccaactggccgacgcctgcccgtatggcgcaggtggtggacaagcatcaggtcaatattctctataccgcacccacggcgatccgcgcgctgatggcggaaggcgataaagcgatcgaaggcaccgaccgttcgtcgctgcgcattctcggttccgtgggcgagccaattaacccggaagcgtgggagtggtactggaaaaaaatcggcaacgagaaatgtccggtggtcgatacctggtggcagaccgaaaccggcggtttcatgatcaccccgctgcctggcgctaccgagctgaaagccggttcggcaacacgtccgttcttcggcgtgcaaccggcgctggtcgataacgaaggtaacccgctggagggggccaccgaaggtagcctggtaatcaccgactcctggccgggtcaggcgcgtacgctgtttggcgatcacgaacgttttgaacagacctacttctccaccttcaaaaatatgtatttcagcggcgacggcgcgcgtcgcgatgaagatggctattactggataaccgggcgtgtggacgacgtgctgaacgtctccggtcaccgtctggggacggcagagattgagtcggcgctggtggcgcatccgaagattgccgaagccgccgtagtaggtattccgcacaatattaaaggtcaggcgatctacgcctacgtcacgcttaatcacggggaggaaccgtcaccagaactgtacgcagaagtccgcaactgggtgcgtaaagagattggcccgctggcgacgccagacgtgctgcactggaccgactccctgcctaaaacccgctccggcaaaattatgcgccgtattctgcgcaaaattgcggcgggcgataccagcaacctgggcgatacctcgacgcttgccgatcctggcgtagtcgagaagctgcttgaagagaagcaggctatcgcgatgccatcgtaa

SEQ ID NO: 47346 - DNA, 1314 bp, Escherichia coli
atgaaaaatataaaattcagcctggcctggcagattctgtttgctatggtgctgggcattctcctgggaagctacctgcactaccatagcgacagccgcgactggctggtcgtcaatttgctctctccggcgggtgatatcttcatccatctgattaaaatgattgttgtgccgattgtgatctccacgctggtggtgggtatcgcgggtgttggtgatgccaaacagctcgggcgtattggcgcgaaaaccattatctacttcgaggtgatcaccaccgtcgccatcattttggggatcactctggcgaacgtcttccagcccggtgccggggtggatatgtcgcagttggcgaccgtcgatatctcgaaatatcagagcactacggaagcggtacaaagcagttcccacggcattatgggcacgattttgtcgctggtgccgacgaacattgtggcgtcgatggcgaaaggcgaaatgctgccgatcatctttttctcggtgctgtttggtctggggctttcttccctgcccgcgacgcatcgtgaaccgctggtgaccgtgttccgctccatctctgaaaccatgtttaaagtgactcacatggtgatgcgttatgcaccggtgggtgtgtttgcgctgattgcggtgacggtggctaactttggtttctcgtctctgtggccactggcgaaactggtgctgctggtgcatttcgccattctgttcttcgcgctggtagtgctgggaattgtggcgcgcctgtgcgggttaagcgtctggatcctgattcgtattctgaaagatgagctgattctggcgtactccactgccagctctgaaagcgtgctgccgcgaattattgagaagatggaagcctacggagcaccggtgtcgatcaccagtttcgtggtgccgaccggttactcttttaaccttgatggttcgacgctgtatcaaagtattgccgctatcttcatcgcgcagttgtatggcattgacctgtccatctggcaggaaatcattctggtgctgacgctgatggtgacctcgaaagggattgctggcgtgcctggcgtgtcgtttgtggtgttgctggcaacgctgggtagcgtaggtattccgctggaaggtctggcgtttattgctggtgttgaccgtatcctcgacatggcgcgtactgcgctgaacgtggtgggtaatgcgctggcggtgctggtgattgccaagtgggaacacaaatttgaccgtaagaaagcgctggcttatgagcgtgaagtgctgggcaaatttgataaaactgcggatcaataa

SEQ ID NO: 47347 - DNA, 2148 bp, Escherichia coli
atgaaaaaagtcgtcacggtttgcccctattgcgcatcaggttgcaaaatcaacctggtcgtcgataacggcaaaatcgtccgggcggaggcagcgcaggggaaaaccaaccagggtaccctgtgtctgaagggttattatggctgggacttcattaacgatacccagatcctgaccccgcgcctgaaaacccccatgatccgtcgccagcgtggcggcaaactcgaacctgtttcctgggatgaggcactgaattacgttgccgagcgcctgagcgccatcaaagagaagtacggtccggatgccatccagacgaccggctcctcgcgtggtacgggtaacgaaaccaactatgtaatgcaaaaatttgcgcgcgccgttattggtaccaataacgttgactgctgcgctcgtgtctgacacggcccatcggttgcaggtctgcaccaatcggtcggtaatggcgcaatgagcaatgctattaacgaaattgataataccgatttagtgttcgttttcgggtacaacccggcggattcccacccaatcgtggcgaatcacgtaattaacgctaaacgtaacggggcgaaaattatcgtctgcgatccgcgcaaaattgaaaccgcgcgcattgctgacatgcacattgcactgaaaaacggctcgaacatcgcgctgttgaatgcgatgggccatgtcattattgaagaaaatctgtacgacaaagcgttcgtcgcttcacgtacagaaggctttgaagagtatcgtaaaatcgttgaaggctacacgccggagtcggttgaagatatcaccggcgtcagcgccagtgagattcgtcaggcggcacggatgtatgcccaggcgaaaagcgccgccatcctgtggggcatgggtgtaacccagttctaccagggcgtggaaaccgtgcgttctctgaccagcctcgcgatgctgaccggtaacctcggtaagccgcatgcgggtgttaacccggttcgtggtcagaacaacgttcagggtgcctgcgatatgggcgcgctgccggatacgtatccgggataccagtacgtgaaagatccggctaaccgcgagaaattcgccaaagcctggggcgtggaaagcctgccagcgcataccggctatcgcatcagcgagctgccgcaccgcgcagcgcatggcgaagtgcgtgccgcgtacattatgggcgaagatccgctacaaactgacgcggagctgtcggcagtacgtaaagcctttgaagatctggaactggttatcgttcaggacatctttatgaccaaaaccgcgtcggcggcggatgttattttaccgtcaacgtcgtggggcgagcatgaaggcgtgtttactgcggctgaccgtggcttccagcgtttcttcaaggcggttgaaccgaaatgggatctgaaaacggactggcaaatcatcagtgaaatcgccacccgtatgggttatccgatgcactacaacaacacccaggagatctgggatgagttgcgtcatctgtgcccggatttctacggtgcgacttacgagaaaatgggcgaactgggcttcattcagtggccttgccgcgatacttcagatgccgatcaggggacttcttatctgtttaaagagaagtttgataccccgaacggtctggcgcagttcttcacctgcgactgggtagcgccaatcgacaaactcaccgacgagtacccgatggtactgtcaacggtgcgtgaagttggtcactactcttgccgttcgatgaccggtaactgtgcggcactggcggcgctggctgatgaacctggctacgcacaaatcaataccgaagacgccaaacgtctgggtattgaagatgaggcattggtttgggtgcactcgcgtaaaggcaaaattatcacccgtgcgcaggtcagcgatcgtccgaacaaaggggcgatttacatgacctaccagtggtggattggtgcctgtaacgagctggttaccgaaaacttaagcccgattacgaaaacgccggagtacaaatactgcgccgttcgcgtcgagccgatcgccgatcagcgcgccgccgagcagtacgtgattgacgagtacaacaagttgaaaactcgcctgcgcgaagcggcactggcgtaa

SEQ ID NO: 47348 - DNA, 1503 bp, Escherichia coli
atgctgaaaaggaaaaaagtaaaaccgattacccttcgtgatgtcaccattattgatgacggtaaactgcgtaaagccattaccgcagcatcactgggtaatgcaatggaatggttcgattttggtgtttatggttttgttgcttacgcattaggtaaagtttttttcccgggggctgaccccagcgtgcagatggttgctgcacttgccactttctccgttccctttctgattcgaccgcttggcggactcttctttggtatgttgggcgataaatatggtcgccagaagatcctcgctatcactattgtgattatgtcgatcagtacgttctgtattggcttaataccgtcctacgacacgattggtatttgggcaccgattctgctgttgatctgtaagatggcacaaggtttctcggtcggcggtgaatataccggggcgtcgatatttgttgcggaatactcccctgaccgtaaacgtggctttatgggcagctggctggacttcggttctattgccgggtttgtgctgggtgcgggcgtggtggtgttaatttcgaccattgtcggcgaagcgaacttcctcgattggggctggcgtattccgttctttatcgctctgccgttagggattatcgggctttacctgcgccatgcgctggaagagactccggcgttccagcagcatgtcgataaactggaacagggcgaccgtgaaggtttgcaggatggcccgaaagtctcgtttaaagagattgccactaaatactggcgcagcctgttgacatgtattggtctggtaattgccaccaacgtgacttactacatgttgctgacctatatgccgagttatttgtcgcataacctgcattactccgaagaccacggggtgctgattattatcgccattatgatcggtatgctgtttgtccagccggtgatgggcttgctgagtgaccgttttggccgtcgtccgtttgtgctacttggtagtgttgccctgtttgtgttggcgatcccggcgtttattctgattaacagtaacgtcatcggcctgatttttgccgggttactgatgctggcggtgatccttaactgctttacgggcgttatggcttctaccttgccagcgatgttcccgacgcatatccgttacagcgcgctggcggcggcatttaatatttcggtgctggttgccggtctgacgccaacgctggcggcctggctggtcgaaagctcgcagaatctgatgatgcctgcctattacctgatggtagtggcggtggttggtttaatcaccggcgtaaccatgaaagagacggcaaatcgtccgttgaaaggtgcgacaccggcggcgtcagatatacaggaagcgaaggaaattctcgtcgagcattacgataatatcgagcagaaaatcgatgatattgaccacgagattgccgatttgcaggcgaaacgtacccgcctggtgcagcaacatccgcgaattgatgaataa

SEQ ID NO: 47349 - DNA, 2271 bp, Escherichia coli
atgatgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggaacatccggacgaacatcaaaacgtcagacaattgatcggtaagcttcatgagcgccaacaaaacgtgccggtcttcctgttgggcgatcgggaaaaagccctcgccgcaatggatcgcgacctgctggagcttgtcgatgaattcgcctggattctggaagataccgccgactttatcgccggacgcgccgttgccgcgatgacccgctaccgccagcagctgttgccgccactgttcagcgcgctgatgaaatatagtgacatccatgaatattcctgggcagcgccaggccaccagggcggcgttggttttaccaaaacacccgccggacgtttctaccatgactactatggtgaaaatctgttccgcaccgacatgggcatcgaacgaacttccctcggttctttgcttgaccatactggcgcatttggcgaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggtttgatgctgacaggcgcgaaaccggtctatatggtgccaagccgcaaccgctacggcattatcgggccaatctatccgcaggaaatgcaacctgaaaccttgcagaagaaaatcagtgaaagcccgctgaccaaagacaaagccgggcaaaaaccgtcttactgcgtggtgaccaactgcacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctggcgatcacaacggtcctaccgttttcgccacccactccacccacaaactgctgaatgcgctgtcacaggcttcttatattcatgtacgtgaaggtcgtggggcgattaacttctcccgcttcaaccaggcctacatgatgcatgccaccacctccccgctgtatgccatctgcgcatccaacgacgtggcggtgtcgatgatggacggcaacagcggcctgtcactgacacaggaagtgattgacgaagcggttgatttccgtcaggcgatggcgcggctatataaagagttcaccgctgacggtagctggttcttcaaaccgtggaacaaagaagtcgtcaccgacccacaaaccggcaaaacctatgactttgctgacgcaccaaccaaactgctgaccaccgttcaggactgctgggtaatgcatccgggcgaaagctggcacggcttcaaagatattccggataactggagtatgctcgacccgattaaagtcagcatccttgctccgggaatgggtgaagatggtgaactggaagaaaccggtgttccggcggcgctggtcactgcctggcttggtcgccacggcattgtacctacccgcaccactgacttccaaattatgttcctgttctctatgggcgtaacccgtgggaaatggggaactctggttaacaccctttgctccttcaaacgccactatgacgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaacgaagcctattccggcctgccggtggcggaagtcaccccgcgtgaagcgtacaacgcgattgtcgacaacaatgtcgaactggtatccattgaaaatctgccaggacgcatcgcggcaaactcagttatcccgtatccgccaggaatcccgatgctgctgtctggtgaaaacttcggcgataaaaacagtccgcaagtaagttatttacgctcgctgcaatcctgggaccaccatttccctggatttgaacacgaaactgaagggactgaaattattgacggtatttaccacgttatgtgcgtgaaagcgtaa

SEQ ID NO: 47350 - DNA, 1356 bp, Escherichia coli
atgatgtctgcacccaaaattacatttatcggcgctggttcgacgattttcgttaaaaatattcttggtgatgtgttccatcgcgaggcgctgaaaacggcgcatattgccctgatggacattgaccccacccgcctggaagagtcgcatattgtggtgcgtaagctgatggattcagcaggggccagcggcaaaatcacctgccacacccaacagaaagaagccttagaggatgccgattttgtcgtggtggcatttcagattggcggttatgaaccttgcacggtgactgatttcgaggtctgtaagcggcatggtctggaacaaaccattgccgatacgttggggccgggcggtattatgcgcgcgctacgtaccattccgcatctgtggcaaatttgcgaggacatgacggaagtctgccccgatgccaccatgctcaactatgttaacccaatggcgatgaatacctgggcgatgtatgcccgctatccgcatatcaaacaggtcgggctgtgccattcggtgcagggaacggcggaagagttggcgcgtgacctcaatatcgacccagctacgctgcgttaccgttgcgcaggtatcaaccatatggcgttttacctggagctggagcgcaaaaccgccgacggcagttatgtgaatctctacccggaactgctggcggcttatgaagcagggcaggcaccgaagccgaatattcatggcaatactcgctgccagaatattgtgcgctacgaaatgttcaaaaagctgggctatttcgtcacggaatcgtcagaacattttgctgagtacacaccgtggtttattaagccaggtcgtgaggatttgattgagcgttataaagtaccgctggatgagtacccgaaacgctgcgtcgagcagctggcgaactggcataaagagctggaggagtataaaaaagcctcccggattgatattaaaccgtcacgggaatatgccagcacaatcatgaacgctatctggactggcgagccgagtgtgatttacggcaacgtccgtaacgatggtttgattgataacctgccacaaggatgttgcgtggaagtagcctgtctggttgatgctaatggcattcagccgaccaaagtcggtacgctaccttcgcatctggccgccctgatgcaaaccaacatcaacgtacagacgctgctgaccgaagctattcttacggaaaatcgcgaccgtgtttaccacgccgcgatgatggacccgcatactgccgccgtgctgggcattgacgaaatatatgctcttgttgacgacctgattgccgcccacggcgactggctgccaggctggttgcaccgttaa

SEQ ID NO: 47351 - DNA, 2148 bp, Escherichia coli
atgaacgttattgcaatattgaatcacatgggggtttattttaaagaagaacccatccgtgaacttcatcgcgcgcttgaacgtctgaacttccagattgtttacccgaacgaccgtgacgacttattaaaactgatcgaaaacaatgcgcgtctgtgcggcgttatttttgactgggataaatataatctcgagctgtgcgaagaaattagcaaaatgaacgagaacctgccgttgtacgcgttcgctaatacgtattccactctcgatgtaagcctgaatgacctgcgtttacagattagcttctttgaatatgcgctgggtgctgctgaagatattgctaataagatcaagcagaccactgacgaatatatcaacactattctgcctccgctgactaaagcactgtttaaatatgttcgtgaaggtaaatatactttctgtactcctggtcacatgggcggtactgcattccagaaaagcccggtaggtagcctgttctatgatttctttggtccgaataccatgaaatctgatatttccatttcagtatctgaactgggttctctgctggatcacagtggtccacacaaagaagcagaacagtatatcgctcgcgtctttaacgcagaccgcagctacatggtgaccaacggtacttccactgcgaacaaaattgttggtatgtactctgctccagcaggcagcaccattctgattgaccgtaactgccacaaatcgctgacccacctgatgatgatgagcgatgttacgccaatctatttccgcccgacccgtaacgcttacggtattcttggtggtatcccacagagtgaattccagcacgctaccattgctaagcgcgtgaaagaaacaccaaacgcaacctggccggtacatgctgtaattaccaactctacctatgatggtctgctgtacaacaccgacttcatcaagaaaacactggatgtgaaatccatccactttgactccgcgtgggtgccttacaccaacttctcaccgatttacgaaggtaaatgcggtatgagcggtggccgtgtagaagggaaagtgatttacgaaacccagtccactcacaaactgctggcggcgttctctcaggcttccatgatccacgttaaaggtgacgtaaacgaagaaacctttaacgaagcctacatgatgcacaccaccacttctccgcactacggtatcgtggcgtccactgaaaccgctgcggcgatgatgaaaggcaatgcaggtaagcgtctgatcaacggttctattgaacgtgcgatcaaattccgtaaagagatcaaacgtctgagaacggaatctgatggctggttctttgatgtatggcagccggatcatatcgatacgactgaatgctggccgctgcgttctgacagcacctggcacggcttcaaaaacatcgataacgagcacatgtatcttgacccgatcaaagtcaccctgctgactccggggatggaaaaagacggcaccatgagcgactttggtattccggccagcatcgtggcgaaatacctcgacgaacatggcatcgttgttgagaaaaccggtccgtataacctgctgttcctgttcagcatcggtatcgataagaccaaagcactgagcctgctgcgtgctctgactgactttaaacgtgcgttcgacctgaacctgcgtgtgaaaaacatgctgccgtctctgtatcgtgaagatcctgaattctatgaaaacatgcgtattcaggaactggctcagaatatccacaaactgattgttcaccacaatctgccggatctgatgtatcgcgcatttgaagtgctgccgacgatggtaatgactccgtatgctgcattccagaaagagctgcacggtatgaccgaagaagtttacctcgacgaaatggtaggtcgtattaacgccaatatgatccttccgtacccgccgggagttcctctggtaatgccgggtgaaatgatcaccgaagaaagccgtccggttctggagttcctgcagatgctgtgtgaaatcggcgctcactatccgggctttgaaaccgatattcacggtgcataccgtcaggctgatggccgctataccgttaaggtattgaaagaagaaagcaaaaaataa

SEQ ID NO: 47352 - DNA, 1482 bp, Escherichia coli
gtgtgtttaaagcaaatcattggcagcttgaaaaagaaggttcacatgtcaaacaacattcgtatcgaagaagatctgttgggtaccagggaagttccagctgatgcctactatggtgttcacactctgagagcgattgaaaacttctatatcagcaacaacaaaatcagtgatattcctgaatttgttcgcggtatggtaatggttaaaaaagccgcagctatggcaaacaaagagctgcaaaccattcctaaaagtgtagcgaatgccatcattgccgcatgtgatgaagtcctgaacaacggaaaatgcatggatcagttcccggtagacgtctaccagggcggcgcaggtacttccgtaaacatgaacaccaacgaagtgctggccaatatcggtctggaactgatgggtcaccaaaaaggtgaatatcagtacctgaacccgaacgaccatgttaacaaatgtcagtccactaacgacgcctacccgaccggtttccgtatcgcagtttactcttccctgattaagctggtagatgcgattaaccaactgcgtgaaggctttgaacgtaaagctgtcgaattccaggacatcctgaaaatgggtcgtacccagctgcaggacgcagtaccgatgaccctcggtcaggaattccgcgctttcagcatcctgctgaaagaagaagtgaaaaacatccaacgtaccgctgaactgctgctggaagttaaccttggtgcaacagcaatcggtactggtctgaacacgccgaaagagtactctccgctggcagtgaaaaaactggctgaagttactggcttcccatgcgtaccggctgaagacctgatcgaagcgacctctgactgcggcgcttatgttatggttcacggcgcgctgaaacgcctggctgtgaagatgtccaaaatctgtaacgacctgcgcttgctctcttcaggcccacgtgccggcctgaacgagatcaacctgccggaactgcaggcgggctcttccatcatgccagctaaagtaaacccggttgttccggaagtggttaaccaggtatgcttcaaagtcatcggtaacgacaccactgttaccatggcagcagaagcaggtcagctgcagttgaacgttatggagccggtcattggccaggccatgttcgaatccgttcacattctgaccaacgcttgctacaacctgctggaaaaatgcattaacggcatcactgctaacaaagaagtgtgcgaaggttacgtttacaactctatcggtatcgttacttacctgaacccgttcatcggtcaccacaacggtgacatcgtgggtaaaatctgtgccgaaaccggtaagagtgtacgtgaagtcgttctggaacgcggtctgttgactgaagcggaacttgacgatattttctccgtacagaatctgatgcacccggcttacaaagcaaaacgctatactgatgaaagcgaacagtaa

SEQ ID NO: 47353 - DNA, 735 bp, Escherichia coli
atggctgagatgaaaaacctgaaaattgaggtggtgcgctataacccggaagtcgataccgcaccgcatagcgcattctatgaagtgccttatgacgcaactacctcattactggatgcgctgggctacatcaaagacaacctggcaccggacctgagctaccgctggtcctgccgtatggcgatttgtggttcctgcggcatgatggttaacaacgtgccaaaactggcatgtaaaaccttcctgcgtgattacaccgacggtatgaaggttgaagcgttagctaacttcccgattgaacgcgatctggtggtcgatatgacccacttcatcgaaagtctggaagcgatcaaaccgtacatcatcggcaactcccgcaccgcggatcagggtactaacatccagaccccggcgcagatggcgaagtatcaccagttctccggttgcatcaactgtggtttgtgctacgccgcgtgcccgcagtttggcctgaacccagagttcatcggtccggctgccattacgctggcgcatcgttataacgaagatagccgcgaccacggtaagaaggagcgtatggcgcagttgaacagccagaacggcgtatggagctgtactttcgtgggctactgctccgaagtctgcccgaaacacgtcgatccggctgcggccattcagcagggcaaagtagaaagttcgaaagactttcttatcgcgaccctgaaaccacgctaa

SEQ ID NO: 47354 - DNA, 1809 bp, Escherichia coli
gtgcaaacctttcaagccgatcttgccattgtaggcgccggtggcgcgggattacgtgctgcaattgctgccgcgcaggcaaatccgaatgcaaaaatcgcactaatctcaaaagtatacccgatgcgtagccataccgttgctgcagaagggggctccgccgctgtcgcgcaggatcatgacagcttcgaatatcactttcacgatacagtagcgggtggcgactggttgtgtgagcaggatgtcgtggattatttcgtccaccactgcccaaccgaaatgacccaactggaactgtggggatgcccatggagccgtcgcccggatggtagcgtcaacgtacgtcgcttcggcggcatgaaaatcgagcgcacctggttcgccgccgataagaccggcttccatatgctgcacacgctgttccagacctctctgcaattcccgcagatccagcgttttgacgaacatttcgtgctggatattctggttgatgatggtcatgttcgcggcctggtagcaatgaacatgatggaaggcacgctggtgcagatccgtgctaacgcggtcgttatggctactggcggtgcgggtcgcgtttatcgttacaacaccaacggcggcatcgttaccggtgacggtatgggtatggcgctaagccacggcgttccgctgcgtgacatggaattcgttcagtatcacccaaccggtctgccaggttccggtatcctgatgaccgaaggttgccgcggtgaaggcggtattctggtcaacaaaaatggctaccgttatctgcaagattacggcatgggcccggaaactccgctgggcgagccgaaaaacaaatatatggaactgggtccacgcgacaaagtctctcaggccttctggcacgaatggcgtaaaggcaacaccatctccacgccgcgtggcgatgtggtttatctcgacttgcgtcacctcggcgagaaaaaactgcatgaacgtctgccgttcatctgcgaactggcgaaagcgtacgttggcgtcgatccggttaaagaaccgattccggtacgtccgaccgcacactacaccatgggcggtatcgaaaccgatcagaactgtgaaacccgcattaaaggtctgttcgccgtgggtgaatgttcctctgttggtctgcacggtgcaaaccgtctgggttctaactccctggcggaactggtggtcttcggccgtctggccggtgaacaagcgacagagcgtgcagcaactgccggtaatggcaacgaagcggcaattgaagcgcaggcagctggcgttgaacaacgtctgaaagatctggttaaccaggatggcggcgaaaactgggcgaagatccgcgacgaaatgggcctggctatggaagaaggctgcggtatctaccgtacgccggaactgatgcagaaaaccatcgacaagctggcagagctgcaggaacgcttcaagcgcgtgcgcatcaccgacacttccagcgtgttcaacaccgacctgctctacaccattgaactgggccacggtctgaacgttgctgaatgtatggcgcactccgcaatggcacgtaaagagtcccgcggcgcgcaccagcgtctggacgaaggttgcaccgagcgtgacgacgtcaacttcctcaaacacaccctcgccttccgcgatgctgatggcacgactcgcctggagtacagcgacgtgaagattactacgctgccgccagctaaacgcgtttacggtggcgaagcggatgcagccgataaggcggaagcagccaataagaaggagaaggcgaatggctga

SEQ ID NO: 47355 - DNA, 969 bp, Escherichia coli
ttgttaaattcatttaaactttcgctacagtacattctgccgaaactatggcttactcgcctggcgggttggggcgcaagcaagcgggcaggatggctgacaaaactggttatcgatctgttcgttaaatactacaaggtcgacatgaaagaggcgcaaaagccggacaccgccagctaccgcacctttaacgaattctttgtccgtccgctgcgtgacgaagtacgcccaatcgataccgatccgaatgtactggtcatgcctgccgatggcgttatcagccagttgggtaaaatcgaagaagataaaatcctgcaagccaaaggccacaactacagcctcgaagccctgctggcaggcaactatctgatggcggacctgttccgcaacggtacgtttgtgaccacttacctctccccgcgtgactaccaccgcgtacacatgccgtgcaacggtattctgcgtgagatgatctacgtgccgggcgatctcttctccgttaaccatctcacggctcagaacgtgccgaatctgtttgcccgtaacgaacgcgtgatttgccttttcgataccgaatttggcccaatggcgcagattctggtcggagcgacgattgttggcagcattgagacggtctgggcgggcaccattacgccgccgcgcgaaggtatcatcaagcgctggacctggcctgccggggaaaacgacggttctgtggcactgctgaaaggccaggaaatgggtcgctttaaactcggttccaccgttatcaacctgtttgcaccgggtaaagtgaatctggttgagcaactggaaagcctgtctgtcacgaaaattggccagccgctggcagtatctaccgaaacctttgttacgccagacgctgaacctgccccgcttcctgctgaagagatcgaagcagaacacgacgccagcccattggttgacgacaaaaaagaccaggtctaa

SEQ ID NO: 47356 - DNA, 1299 bp, Escherichia coli
atgggtaacaacgtcgtcgtactgggcacccaatggggtgacgaaggtaaaggtaagatcgtcgatcttctgactgaacgggctaaatatgttgtacgctaccagggcggtcacaacgcaggccatactctcgtaatcaacggtgaaaaaaccgttctccatcttattccatcaggtattctccgcgagaatgtaaccagcatcatcggtaacggtgttgtgctgtctccggccgcgctgatgaaagagatgaaagaactggaagaccgtggcatccccgttcgtgagcgtctgctgctgtctgaagcatgtccgctgatccttgattatcacgttgcgctggataacgcgcgtgagaaagcgcgtggcgcgaaagcgatcggcaccaccggtcgtggtatcgggcctgcttatgaagataaagtagcacgtcgcggtctgcgtgttggcgaccttttcgacaaagaaaccttcgctgaaaaactgaaagaagtgatggaatatcacaacttccagttggttaactactacaaagctgaagcggttgattaccagaaagttctggatgatacgatggctgttgccgacatcctgacttctatggtggttgacgtttctgacctgctcgaccaggcgcgtcagcgtggcgatttcgtcatgtttgaaggtgcgcagggtacgctgctggatatcgaccacggtacttatccgtacgtaacttcttccaacaccactgctggtggcgtggcgaccggttccggcctgggcccgcgttatgttgattacgttctgggtatcctcaaagcttactccactcgtgtaggtgcaggtccgttcccgaccgaactgtttgatgaaactggcgagttcctctgcaagcagggtaacgaattcggcgcaactacggggcgtcgtcgtcgtaccggctggctggacaccgttgccgttcgtcgtgcggtacagctgaactccctgtctggcttctgcctgactaaactggacgttctggatggcctgaaagaggttaaactctgcgtggcttaccgtatgccggatggtcgcgaagtgactaccactccgctggcagctgacgactggaaaggtgtagagccgatttacgaaaccatgccgggctggtctgaatccaccttcggcgtgaaagatcgtagcggcctgccgcaggcggcgctgaactatatcaagcgtattgaagagctgactggtgtgccgatcgatatcatctctaccggtccggatcgtactgaaaccatgattctgcgcgacccgttcgacgcgtaa

SEQ ID NO: 47357 - DNA, 1413 bp, Escherichia coli
atggtagatcaggtaaaagtcgttgccgatgatcaggctccggctgaacagtcgctacggcgcaatctcacaaaccgacatattcagcttattgccattggcggtgccattggtacggggttgtttatggggtctggcaaaacgattagccttgccgggccgtcgatcattttcgtttatatgatcattggttttatgctctttttcgtgatgcgggcaatgggggaattgctgctttcgaatctggaatacaaatcttttagtgacttcgcttccgatttactcgggccgtgggcaggatatttcaccggctggacttactggttctgctgggttgtaaccggtatggcagacgtggtggcgatcacggcttatgctcagttctggttccccgatctctccgactgggtcgcctcgctggcggtgatagtgctgctgctgacgctcaatctcgccaccgtgaaaatgttcggtgagatggagttctggtttgcgatgatcaaaatcgtcgccattgtgtcgctgattgtcgtcggcctggtcatggtggcgatgcactttcagtcaccgactggtgtggaagcgtcattcgcgcatttgtggaatgacggcggctggttcccgaaaggtttaagtggcttctttgccggattccagatagcggttttcgctttcgtggggattgagctggtaggtacaacagctgcggaaaccaaagatccagagaaatcactgccacgcgcgattaactccattccgatccgtatcattatgttctacgtcttcgcgctgattgtgattatgtccgtgacgccgtggagttcggtagtcccggagaaaagcccgtttgttgaactgttcgtgttggtagggctgcctgctgccgcaagcgtgatcaactttgtggtgctgacctctgcggcgtcttccgctaacagcggcgtcttctctaccagccgtatgctgtttggtctggcgcaggaaggtgtggcaccgaaagcgttcgctaaactttctaagcgcgcagtacccgcgaaagggctgacgttctcgtgtatctgtctgctcggcggcgtggtgatgttgtatgtgaatcctagtgtgattggcgcgttcacgatgattacaaccgtttccgcgattctgtttatgttcgtctggacgattatcctttgctcgtaccttgtgtatcgcaaacagcgtcctcatctacatgagaagtcgatctacaagatgccgctcggcaagctgatgtgctgggtatgtatggcgttctttgtgttcgtggtcgtgttgctgacactggaagatgacactcgccaggcgctgctggttaccccgctgtggtttatcgcgctggggttgggctggctgtttattggtaagaagcgggctgctgaactgcggaaataa

SEQ ID NO: 47358 - DNA, 639 bp, Escherichia coli
atgagtttatttgataaaaagcatctggtttcccccgccgatgccctgcctggacgtaacaccccgatgcccgtagccacgctgcatgcggtcaacggtcactcaatgaccaatgtacctgacggaatggagattgccatttttgcgatgggttgtttctggggtgtggagcgtctgttctggcagttacccggcgtttacagcaccgccgcaggctataccggcggctatacgccaaatccgacttatcgggaagtgtgctccggtgatacgggtcatgccgaagcggtacgcattgtttacgatccttccgtcatcagctatgagcagttgctacaggtattttgggagaatcacgatcccgcccagggaatgcgtcagggcaatgaccacggcacgcagtatcgttcagcgatttatccgctgaccccagaacaggatgccgcagctcgcgccagtctggaacgttttcaggcggcgatgcttgccgccgatgacgatcgtcacatcaccacggaaatcgctaacgccacaccgttttattatgccgaagatgaccaccagcaatatctgcataaaaacccgtatggttactgtggaattggcggaattggcgtctgtctgccgccggaagcatag

SEQ ID NO: 47359 - DNA, 999 bp, Escherichia coli
atgaaaacgttaggtgaatttattgtcgaaaagcagcacgagttttctcatgctaccggtgagctcactgctttgctgtcggcaataaaactgggcgccaagattatccatcgcgatatcaacaaagcaggactggttgatatcctgggtgccagcggtgctgagaacgtgcagggcgaggttcagcagaaactcgacttgttcgctaatgaaaaactgaaagccgcactgaaagcacgcgatatcgttgcgggcattgcctctgaagaagaagatgagattgtcgtctttgaaggctgtgaacacgcaaaatacgtggtgctgatggaccccctggatggctcgtccaacatcgatgttaacgtctctgtcggtaccattttctccatctaccgccgcgttacgcctgttggcacgccggtaacggaagaagatttcctccagcctggtaacaaacaggttgcggcaggttacgtggtatacggctcctctaccatgctggtttacaccaccggatgcggtgttcacgcctttacttacgatccttcgctcggcgttttctgcctgtgccaggaacggatgcgcttcccggagaaaggcaaaacctactccatcaacgaaggaaactacattaagtttccgaacggggtgaagaagtacattaaattctgccaggaagaagataaatccaccaaccgcccttatacctcacgttatatcggttcactggtcgcggatttccaccgtaacctgctgaaaggcggtatttatctctacccaagcaccgccagccacccggacggcaaactgcgtttgctgtatgagtgcaacccgatggcattcctggcggaacaagcgggcggtaaagcgagcgatggcaaagagcgtattctggatatcatcccggaaaccctgcaccagcgccgttcattctttgtcggcaacgaccatatggttgaagatgtcgaacgctttatccgtgagttcccggacgcgtaa

SEQ ID NO: 47360 - DNA, 1656 bp, Escherichia coli
atgactcatcttccccactggtggcaaaacggcgttatctaccagatttatccaaagagttttcaggacaccacgggtagcggtaccggcgatttacgtggcgttatccaacacctggactatctgcataaactgggcgttgatgccatctggctaacccccttttatgtctctccccaggtcgataacggttacgacgtagcgaactatacggcgattgatcccacctacggcacgctggacgattttgacgaactggtgacgcaggcaaaatcgcgcgggattcgtatcattctcgatatggtgtttaaccatacctctacccaacatgcctggtttcgcgaggcgctgaacaaagaaagcccttaccgccagttttatatctggcgcgatggagaaccagaaacgccaccgaacaactggcgttcaaaatttggcggtagtgcgtggcgctggcatgcggaaagcgaacagtactatttgcatctctttgcaccagaacaggcggatctcaactgggagaatccagcggtacgcgcagagctgaaaaaagtctgtgagttctgggccgatcgtggggtcgacgggttgcgcctggatgtggtgaatctgatctccaaagacccgcgtttccctgaagacctggacggcgacgggcgtcgcttctacaccgacgggccacgagcacacgagtttttgcacgagatgaaccgcgatgtgtttacgccacgcgggttaatgaccgtaggtgaaatgtcctccaccagccttgagcattgccagcgatacgcggctctgacaggcagtgaattgtcgatgacctttaattttcatcacctgaaggtcgattatcccggtggtgaaaaatggacgctggctaaacctgactttgtggcgttgaaaacattgttccgccactggcaacaaggaatgcacaacgtagcatggaatgccttgttctggtgtaaccacgatcagccgcgcattgtttctcgctttggtgatgaaggtgaataccgcgtgcctgcggcaaaaatgctggcgatggtgctgcatggcatgcagggaacgccgtatatctaccagggcgaagagattggcatgaccaacccgcatttcacgcgcattactgactatcgcgacgtagagagcctcaatatgtttgccgagctgcgcaacgatgggcgtgatgccgacgagttattggcaatcctcgccagtaaatcccgtgacaacagtcgcacgcccatgcaatggagcaacggcgataatgccgggtttacggctggcgaaccgtggattggcctgggcgataactatcaacaaatcaacgtagaagccgcgctggccgatgattcctcggtgttttacacctaccaaaagttaatcgcactgcgtaagcaggaagccatcctgacatggggcaattaccaggatctgctgccaaacagccctgtattgtggtgctatcgccgtgaatggaaggggcaaaccttgctggtcattgccaaccttagccgtgagatccaaccctggcaggcagggcaaatgcgcggcaactggcagcttgtgatgcataactacgaagaagcctcaccacaaccctgtgccatgaatttacggccttttgaggctgtctggtggttacagaagtaa

SEQ ID NO: 47361 - DNA, 2697 bp, Escherichia coli
atgtttaaagaaatttttacccggctcattcgccatttaccttcccgtctggttcatcgtgatccattgcctggcgcgcagcagacagtgaatacggtggtcccgccgtccttaagtgcgcattgcctgaaaatggcggtgatgcccgaagaagaattgtggaaaacgttcgacacccatccggaagggttaaatcaggcggaagtggaatctgcccgcgaacaacatggtgaaaataaattacccgcacaacaaccgtcgccgtggtgggtacatttatgggtctgctatcgcaacccctttaatattttactcaccattctcggcgctatttcttacgccacggaagatttatttgctgcgggcgttatcgcgctaatggtcgctatttctacgttgctgaactttattcaggaagcacgttccactaaagcggcagatgccctgaaagcgatggtcagcaatactgcgacggtgctgcgcgtaattaacgacaaaggcgaaaatggctggctggagatcccgatcgaccagctggtgcccggcgatattataaaactggcggcgggagatatgatcccggcagatttacgtatcttgcaggcgcgggatctgttcgtcgctcaggcgtcgttaaccggtgagtctctgcccgtagaaaaagccgctaccactcgccagccggagcacagcaatccgctggagtgcgacacgctgtgttttatgggcaccaccgtggtgagcggcacggcacaagcaatggtgattgctacaggtgccaatacctggtttggtcaactggcggggcgtgttagtgagcaggaaagcgagccgaatgcctttcagcaagggatcagccgcgtcagtatgctgctgattcgctttatgctggtgatggcaccggtggtgctgttaatcaatggttacaccaaaggcgactggtgggaagcggcgctgtttgcgctttcggtcgcggtaggcctaacgccggaaatgttgccgatgattgttacctcgacgctggcgcgcggcgcagtaaagctgtcgaaacagaaagtgatcgtcaaacatctggatgctattcagaactttggcgcaatggatattctgtgcactgataaaaccggcaccctgacgcaggataaaattgtgctggagaatcataccgatatctccggtaaaaccagcgaacgcgtgctgcatagcgcgtggttgaacagtcattatcagaccggacttaaaaacctgctcgatacagcggtgctcgaaggtacggatgaagagtcagcgcgctcgctggccagtcgttggcaaaaaattgatgagattccgtttgatttcgagcgtcgccggatgtcggtggtagtggcagaaaataccgagcaccatcagctggtttgcaaaggtgcattgcaggaaatcctcaatgtgtgttcgcaggtgcgtcacaatggcgagattgtgccgctcgatgacatcatgctgcgtaagattaagcgggttactgatacgctgaatcgtcaggggctgcgcgtggttgcggtggcgacgaaatacctgccagcgcgtgaaggagattaccagcgggcggatgaatccgacctgatcctcgaaggatatattgcttttcttgatccgccaaaagagacaaccgctccggcactgaaggcattaaaagcgagtggaattaccgtaaaaatccttactggcgacagtgagttagttgcagcgaaagtgtgccatgaagtggggctggacgcgggagaggtggtcattggtagtgatattgaaacgctatctgacgacgaactggcaaatcttgcacagcgtaccacgctgtttgcccgcctgacgccgatgcataaagaacgcattgtgaccttactgaagcgcgaagggcatgtggttggctttatgggcgatggtattaatgatgcgcccgccttacgcgctgcggatatcggcatttctgtggacggcgcggtagatattgcccgtgaagcggctgatatcatcctgctggaaaaaagcctgatggtgctggaagagggggttattgagggacgtcgcactttcgccaacatgctgaaatacatcaaaatgacggcgagctctaacttcggtaatgtgttcagcgtgctggtagcgagtgctttcttgcccttcctgccgatgttgccgttacacttgcttattcagaacctgctgtacgatgtgtcacaggtggcgatcccgtttgataacgtcgacgacgagcaaattcaaaagccgcagcgttggaatccggcggatctggggcgctttatgatcttcttcggaccgatcagctcgatcttcgatattttgacgttttgcctgatgtggtgggtattccatgccaacacgccggaaacgcaaacgctgttccagtcgggatggtttgtggtgggcttactgtcgcaaacgctgattgtgcatatgatccgcacccgccgtgtgccgtttattcagagctgtgcatcgtggccgttaatgatcatgaccgtgatcgtgatgattgtcgggatcgcattgccgttttcaccgctggccagttatctgcaattacaggcgctgccgttaagctatttcccgtggctggttgcgattctggcagggtatatgacattaacccagttggtgaaagggttctatagccgtcgttacggctggcaataa

SEQ ID NO: 47362 - DNA, 462 bp, Escherichia coli
atgacacacgataataaattgcaggttgaagctattaaacgcggcacggtaattgaccatatccccgcccagatcggttttaagctgttgagtctgttcaagctgaccgaaacggatcagcgcatcaccattggtctgaacctgccttctggcgagatgggccgcaaagatctgatcaaaatcgaaaatacctttttgagtgaagatcaagtagatcaactggcattgtatgcgccgcaagccacggttaaccgtatcgacaactatgaagtggtgggtaaatcgcgcccaagtctgccggagcgcatcgacaatgtgctggtctgcccgaacagcaactgtatcagccatgccgaaccggtttcatccagctttgccgtgcgaaaacgcgccaatgatatcgcgctcaaatgcaaatactgtgaaaaagagttttcccataatgtggtgctggccaattaa

SEQ ID NO: 47363 - DNA, 936 bp, Escherichia coli
atggctaatccgctatatcagaaacatatcatttccataaacgaccttagtcgcgatgaccttaatctggtgctggcgacagcggcgaaactgaaagcaaacccgcaaccagagctgttgaagcacaaagtcattgccagctgtttcttcgaagcctctacccgtacccgcctctctttcgaaacatctatgcaccgcctgggggccagcgtggtgggcttctccgacagcgccaatacatcactgggtaaaaagggcgaaacgctggccgataccatttcggttatcagcacttacgtcgatgcgatagtgatgcgtcatccgcaggaaggtgcggcgcgcctggccaccgagttttccggcaatgtaccggtactgaatgccggtgatggctccaaccaacatccgacgcaaaccttgctggacttattcactattcaggaaacccaggggcgtctggacaatctccacgtcgcaatggttggtgacctgaaatatggccgcaccgttcactccctgactcaggcgttagcgaagttcgacggcaaccgtttttacttcatcgcgccggacgcgctggcaatgccgcaatacattctggatatgctcgatgaaaaagggatcgcatggagtctgcacagctctattgaagaagtgatggcggaagtagacatcctgtacatgacccgcgtgcaaaaagagcgtctggacccgtccgagtacgccaacgtgaaagcgcagtttgttcttcgcgccagcgatctccacaacgccaaagccaatatgaaagtgctgcatccgctgccgcgtgttgatgagattgcgacggatgttgataaaacgccacacgcctggtacttccagcaggcaggcaacgggattttcgctcgccaggcgttactggcactggttctgaatcgcgatctggtactgtaa

SEQ ID NO: 47364 - DNA, 714 bp, Escherichia coli
atgggcgcttttacaggtaagacagttctcatcctcggtggcagtcgtggtatcggtgccgctatcgtacgtcgtttcgtcaccgatggggccaatgtacgattcacctatgcggggtcgaaagatgccgctaaacgcctggcacaagagactggagcgacagcagtattcacagatagtgctgacagagacgctgtcattgatgtcgttcgtaagagcggcgcattggatatcctggtggtaaatgcaggtattggcgtctttggcgaggccctggaattaaatgccgacgatattgatcgccttttcaaaatcaatattcatgctccttatcatgcctctgttgaagccgcccggcagatgcccgaaggcgggcgcatcttaatcatcggctccgtgaatggcgatcgtatgcctgttgcaggcatggctgcttatgccgccagcaaatctgccctgcaaggcatggcgcgcgggctggcccgtgattttggaccgcgtgggatcaccattaacgtcgtccagccagggccaattgataccgacgctaatcccgccaacgggccaatgcgcgatatgttgcatagtttgatggctatcaaaagacatgggcaaccggaagaggtcgctggtatggtcgcatggttagcagggccagaagccagttttgttaccggcgcgatgcataccattgatggcgcgtttggcgcataa

SEQ ID NO: 47365 - DNA, 1005 bp, Escherichia coli
atgtccgggttttatcataagcatttcctgaaattactcgatttcacgccagctgaactcaacagcctgctgcagttagccgcgaagctgaaagccgataagaaaagcggtaaagaagaagccaaactcactggtaaaaacatcgcgctcatcttcgaaaaagactcgactcgtacccgatgctctttcgaagttgccgcatatgaccagggtgctcgcgttacttatctcggcccaagcggcagccagattggtcataaagagtcgattaaagacactgcccgcgtgcttggtcgcatgtatgacggtattcagtatcgcggctatggtcaggagattgtcgaaacactggcggaatacgctagcgtgccggtatggaatggcctgaccaatgagttccatcccacgcagctgctggcggatcttctcaccatgcaggagcatttgcccggcaaagcgttcaacgaaatgacgctggtctatgcaggtgacgcgcgtaacaacatgggcaattcgatgctcgaagctgcggcgcttaccggtctggatttgcgtctggtcgcgccacaagcgtgctggccggaagctgcgctggttacggaatgccgcgccctggcacagcaaaatggtgggaatattacgctgactgaagatgtcgcgaagggagttgaaggtgctgactttatctataccgatgtgtgggtgtcgatgggggaagcaaaagagaaatgggcggaacggattgcattgctgcgtgaatatcaggtgaacagcaagatgatgcagttgaccggtaacccggaggtcaaattcctccactgcctgcccgcgtttcatgacgaccaaacgacgcttggcaagaaaatggcggaagaatttggcctacatggcggtatggaagtcactgatgaggtcttcgaatctgccgccagcattgtttttgatcaggcggaaaaccgtatgcatactatcaaagcggtgatggtcgcgacgctcagtaaataa

SEQ ID NO: 47366 - DNA, 765 bp, Escherichia coli
atgaacgatctattttcactggcaggaaaaaatatcttgattaccggttcagcacagggcattggctttttactggcaaccggcctgggtaaatatggcgcacaaataattattaatgatattactgccgaacgcgcagaacttgctgtagaaaaactccaccaggagggtattcaggccgttgccgcaccttttaatgttactcataaacatgaaattgatgccgccgttgaacatatcgaaaaggacatcggccccattgatgtgctggtgaataacgccggtatccagcgccgtcatccttttactgagttccctgaacaagagtggaatgatgtgatcgcagtaaaccagaccgccgtgttcctggtatcgcaagcggtaactcgtcacatggttgaacgcaaggcaggtaaagttattaatatttgctcgatgcaaagcgaactgggacgtgacaccatcaccccttatgccgcatcgaaaggggcggtaaaaatgctcacccgcggcatgtgcgtcgagctggcgcgccacaatattcaggtcaacggtattgcgccgggctatttcaaaacagaaatgactaaagcactggttgaggacgaagccttcaccgcctggttgtgcaaacggacccccgccgcacgctggggagatccgcaggaactgattggtgctgcggtgttcctttcttcaaaagcctctgatttcgtaaacggccacctgttgtttgttgatggcggcatgttagtggctgtttaa

SEQ ID NO: 47367 - DNA, 1032 bp, Escherichia coli
atgcaagtgaaaacacagtcctgcgttgttgcgggcaagaaaactgttgccgttaccgagcagacgatagattggaataataatggaacattagtacaaataacccgaggtggaatttgcggttccgatttacattattatcaggaaggaaaagtaggtaatttcatgataaaggcaccgatggtgttaggtcatgaagttatcggtaaagttattcatagcgactcatcagaattacatgaagggcaaacggtagccattaatccgtctaaaccgtgcggtcactgcaaatactgcattgaacataacgagaatcagtgtacagatatgcgtttttttggcagtgccatgtatttccctcatgttgatggtggttttacccgttataaaatggtcgaaacgtcgcaatgtgtcccttatccggccaaagctgacgaaaaggttatggcttttgccgaacctttagccgtcgcgattcatgccgcacatcaggccggcgagttacagggcaagcgagtatttatttccggtgttggacccattggctgcctgattgtcagtgcagtgaaaacactgggggccgcggaaattgtctgtgctgatgtgagtccccgttccctttcgctgggcaaagagatgggggcggatgtgctcgtaaacccacaaaacgacgacatggatcactggaaagcggaaaaaggctatttcgatgtcagctttgaagtgtccggtcatccttcatcagtgaatacctgtctggaggtcactcgtgcacgcggcgtaatggtgcaggtaggtatgggaggcgcgatggcagaattcccaatgatgacgttgattggtaaggagatttcactcagaggctctttccgttttaccagcgaatttaataccgcagtgtcatggctggcgaatggcgttatcaatccactgcctttactgagtgctgaatatcccttcactgacctggaagaggcgctacgtttcgccggtgataaaacccaggcagcaaaagtccagcttgttttctaa

SEQ ID NO: 47368 - DNA, 564 bp, Escherichia coli
atggcgggtgaaagctttattttgatgggcgtttcagggagtggtaaaacattaattggtagcaaggttgccgcgttattatctgctaaatttattgatggtgacgatcttcatccagccaaaaatatagataaaatgtcgcagggtattccattatctgatgaagatcgacttccctggctggaacgcttaaatgatgcttcatacagtctttataaaaagaatgaaacaggatttattgtctgttcatcattaaaaaaacagtatcgtgatattttacgcaagggtagcccccatgttcatttcctctggttagatggcgactatgaaactattctcgcgcgaatgcagcgtcgggctgggcattttatgccggtagcgttactaaaaagtcagtttgaggcactggagcgtccacaagcagatgaacaggatattgtgcgcattgatatcaaccatgatattgccaatgtcaccgaacaatgtcggcaggctgtgctggcgatacgacaaaacagaatatgtgcgaaagagggcagcgcctcagatcagcgctgcgaatga

SEQ ID NO: 47369 - DNA, 1062 bp, Escherichia coli
atgctctacacttcccaaacaacaccagagaaggaccaaaaaatgtcgatgataaaaagctatgccgcaaaagaagcgggcggcgaactggaagtttatgagtacgatcccggtgagctgaggccacaagatgttgaagtgcaggtggattactgcgggatctgccattccgatctgtcgatgatcgataacgaatggggattttcacaatatccgctggttgccgggcatgaggtgattgggcgcgtggtggcactcgggagcgccgcgcaggataaaggtttgcaggtcggtcagcgtgtcgggattggctggacggcgcgtagctgtggtcactgcgacgcctgtattagcggtaatcagatcaactgcgagcaaggtgcggtgccgacgattatgaatcgcggtggctttgccgagaagttgcgtgcggactggcaatgggtgattccactgccagaaaatattgatatcgagtccgccgggccgctgttgtgcggcggtatcacggtctttaaaccactgttgatgcaccatatcactgctaccagccgcgttggggtaattggtattggcgggctggggcatatcgctataaaacttctgcacgcaatgggatgcgaggtgacagcctttagttctaatccggcgaaagagcaggaagtgctggcgatgggtgccgataaagtggtgaatagccgcgatccgcaggcactgaaagcactggcggggcagtttgatctcattatcaacaccgtcaacgtcagcctcgactggcagccctattttgaggcgctgacctatggcggtaatttccatacggtcggtgcggttctcacgccgctgtctgttccggcctttacgttaattgcgggcgatcgcagcgtctctggttctgctaccggcacgccttatgagctgcgtaagctgatgcgttttgccgcccgcagcaaggttgcgccgaccaccgaactgttcccgatgtcgaaaattaacgacgccatccagcatgtgcgcgacggtaaggcgcgttaccgcgtggtgttgaaagccgatttttga

SEQ ID NO: 47370 - DNA, 960 bp, Escherichia coli
atgggctgggatacagaaacgaaaatgagcacttacgaaaaggaaactgaggtaatgaaaaaattcagcggcattattccaccggtatccagcacgtttcatcgtgacggaacccttgataaaaaggcaatgcgcgaagttgccgacttcctgattaataaaggggtcgacgggctgttttatctgggtaccggtggtgaatttagccaaatgaatacagcccagcgcatggcactcgccgaagaagctgtaaccattgtcgacgggcgagtgccggtattgattggcgtcggttccccttccactgacgaagcggtcaaactggcgcagcatgcgcaagcctacggcgctgatggtatcgtcgccatcaacccctactactggaaagtcgcaccacgaaatcttgacgactattaccagcagatcgcccgtagcgtcaccctaccggtgatcctgtacaactttccggatctgacgggtcaggacttaaccccggaaaccgtgacgcgtctggctctgcaaaacgagaatatcgttggcatcaaagacaccatcgacagcgttggtcacttgcgtacgatgatcaacacagttaagtcggtacgcccgtcgttttcggtattctgcggttacgatgatcatttgctgaatacgatgctgctgggcggcgacggtgcgataaccgccagcgctaactttgctccggaactctccgtcggcatctaccgcgcctggcgtgaaggcgatctggcgaccgctgcgacgctgaataaaaaactactacaactgcccgctatttacgccctcgaaacaccgtttgtctcactgatcaaatacagcatgcagtgtgtcgggctgcctgtagagacatattgcttaccaccgattcttgaagcatctgaagaagcaaaagataaagtccacgtgctgcttaccgcgcagggcattttaccagtctga

SEQ ID NO: 47371 - DNA, 1362 bp, Escherichia coli
gtggaaaaagaaaatatcaccatcgatccgcgttcttcatttactccatcttcgtcggcagatattcccgtgccaccagatggattagttcaacgcagtacccgaattaaacgcattcaaaccaccgccatgttgttattattttttgcggcggtaatcaattatctcgaccgcagttcgctgtcggtagcaaatttaacgattcgtgaagaattgggattaagtgccaccgaaatcggcgctttgctctccgtgttttcactcgcttacgggattgcgcaacttccttgcggcccactattggatcgtaaaggcccacgcctgatgctgggactggggatgttcttctggtcactgttccaggcaatgtctggcatggtgcacaactttacgcagttcgtgttggtgcgtatcggtatggggattggtgaagcgccgatgaacccatgcggtgtaaaagtcattaacgactggttcaacatcaaagagcgcggacgcccgatgggcttcttcaacgcagcttctaccattggcgttgccgtaagcccaccgattctggcggcgatgatgctggtgatgggctggcgcgggatgtttattaccattggtgtactggggatttttctcgccatcggctggtatatgctctatcgcaaccgcgagcacgtagaactgactgccgttgagcaagcttatctcaatgcaggtagcgtcaatgcccgccgagatccgctcagttttgccgaatggcgcagcctgttccgtaaccgtacaatgtggggaatgatgctcggattcagtggcatcaactacactgcgtggctgtatctggcctggcttcctggttacctgcaaacagcctataacctggatttaaaaagcacagggttgatggcggctatccctttcctgtttggggctgccgggatgctggtcaacggttacgttaccgactggctggtcaaagggggaatggctccgattaaaagccgtaagatctgcattattgccgggatgttctgttctgccgcctttacgctgatagtaccacaagcgacaacatccatgacggcggttctgctgattggcatggcactgttctgtattcactttgccggaacatcctgctggggcttgatccacgtcgcagttgcttctcgcatgactgcgtcggtgggcagtatccagaactttgccagcttcatctgcgcctcttttgcgccgatcattactggttttattgttgataccacccactcattccgtctggcactaatcatctgcggttgcgtcaccgcagcgggggcactggcgtacatcttcctggttcgtcagccgatcaacgacccacgtaaagattaa

SEQ ID NO: 47372 - DNA, 1038 bp, Escherichia coli
gtggagagccgaatcatgtctacgatgaatgttttaatttgccagcagccgaaagaattagtctggaaacaacgcgagatacctattccgggtgacaatgaagcattaataaaaattaagtctgtcgggatttgcggtaccgatattcatgcctggggtggaaatcaaccattttttagttatccacgtgttttaggccatgaaatatgtggggagattgttgggctgggtaaaaatattgctgatcttaaaaatggtcagcaagttgctgtgatcccttatgttgcctgtcagcaatgcccggcgtgtaaaagcgggcgtaccaattgctgtgaaaaaatttcagtcattggcgtgcatcaggatggcggttttagtgagtatttgagcgtgccggtggcgaacattttgcccgcagacggtattgacccgcaggcggcagcattgattgaacctttcgctattagcgctcatgcggtgcgtcgcgcagccattgctcccggcgagcaggtgctggtggtcggggcggggccaatcggtctgggcgcggcggcaatcgctaaagccgatggcgcacaggtggtggtggcggataccagtccggcgcgccgtgaacatgtggcaacgcgtctggaattacctttactggacccgtcagccgaagattttgacgcgcagctacgggcgcagtttggtggttcgctggcgcagaaagtgatcgacgcgacaggtaatcaacatgcgatgaataacaccgtgaatttgattcgtcacggcggcacggtggtatttgtcggcctgtttaaaggtgagttgcagttctccgatccggaattccataaaaaagaaacgacgatgatgggcagccgcaacgccacgccggaagattttgctaaagtcggtcgactgatggcggaaggaaaaatcactgctgacatgatgttaacccatcgctatccgttcgccacgctggcagaaacctacgagcgcgatgtgattaacaatcgtgagttaattaaaggcgtaattactttctga

SEQ ID NO: 47373 - DNA, 1668 bp, Escherichia coli
gtggctcaattcgtttataccatgcatcgtgtcggcaaagttgttccgccgaaacgtcatattttgaaaaacatctctctgagtttcttccctggggcaaaaattggtgtcctgggtctgaatggcgcgggtaagtccaccctgctgcgcattatggcgggcattgataaagacatcgaaggtgaagcgcgtccgcagccagacatcaagattggttatctgccgcaggaaccgcagctgaacccggaacacaccgtgcgtgagtccattgaagaagcggtttcagaagtggttaacgccctgaaacgcctggatgaagtgtatgcgctgtacgccgatccggatgccgattttgacaagctggccgctgaacaaggccgtctggaagagatcattcaggctcacgacggtcataatctgaacgtacagctggagcgtgcggcggatgcgctacgtctgccggactgggacgcgaaaatcgctaacctctccggtggtgaacgtcgtcgcgtagcgttgtgccgcctgctgctggaaaaaccagacatgctgctgctcgacgaaccgaccaaccacctggatgccgaatccgtggcctggctggaacgcttcctgcacgacttcgaaggcaccgttgtggcgattacccacgaccgttacttcctcgataacgttgcaggctggatcctcgaacttgaccgcggtgaaggtattccgtgggaaggtaactactcctcctggctggagcagaaagatcagcgcctggcgcaggaagcttcacaagaagcggcgcgtcgtaagtcgattgagaaagagctggaatgggtacgtcaaggtactaaaggccgtcagtcgaaaggtaaagcacgtctggcgcgctttgaagaactgaacagcaccgaatatcagaaacgtaacgaaaccaacgaactgtttattccacctggaccgcgtctgggcgataaagtgctggaagtcagcaacctgcgtaaatcctatggcgatcgtctgctgattgatgacctgagcttctcgatcccgaaaggagcgatcgtcgggatcatcggtccgaacggtgcgggtaaatcgaccctgttccgtatgatctctggtcaggaacagccggacagcggcaccatcactttgggtgaaacggtgaaactggcgtcggttgatcagttccgtgactcaatggataacagcaaaaccgtttgggaagaagtttccggcgggctggatatcatgaagatcggcaacaccgagatgccaagccgcgcctacgttggccgctttaactttaaaggggttgatcagggtaaacgcgttggtgaactctccggtggtgagcgcggtcgtctgcatctggcgaagctgctgcaggttggcggcaacatgctgctgctcgacgaaccaaccaacgacctggatatcgaaaccctgcgcgcgctggaaaacgccctgctggagttcccgggctgtgcgatggttatctcgcacgaccgttggttcctcgaccgtatcgccacgcacattctggattaccaggatgaaggtaaagttgagttcttcgaaggtaactttaccgagtacgaagagtacaagaaacgcacgctgggcgcagacgcgctggagccgaagcgtatcaagtacaagcgtattgcgaagtaa

SEQ ID NO: 47374 - DNA, 648 bp, Escherichia coli
atgttacaggtatacctagtccgccacggtgaaacgcagtggaacgccgagcgacgtattcagggccagtctgacagcccgctgaccgccaaaggtgagcaacaggcgatgcaggtggcaacccgtgccaaagagcttggcattacgcatatcatcagtagcgatttaggacgcacccggcgtacggcggaaatcatcgcccaggcctgcggctgtgacatcatctttgattctcgcctgcgtgaattaaacatgggtgtgctggaaaaaagacatatcgattctctgaccgaagaagaagagaactggcgtcggcagctggtcaatggcaccgttgacgggcgtattcctgaaggcgagtcaatgcaggagctcagcgatcgcgtcaatgcggcactggaatcttgccgggacttaccgcagggaagccgaccgctgctggtgagtcatggtattgcactgggatgcctggtgagtacgattctcggattaccagcatgggcagagcgccgcttacgtctgcgtaactgttctatttcgcgcgtggattatcaggaaagcctgtggctggcgtctggctgggtcgttgaaaccgcaggggacatctcgcatctggacgcccctgcattagatgagctgcagcgttaa
